US007700101B2

(12) United States Patent
Allen et al.

(10) Patent No.: US 7,700,101 B2
(45) Date of Patent: Apr. 20, 2010

(54) REAGENTS AND METHOD FOR MODULATING DKK-MEDIATED INTERACTIONS

(75) Inventors: Kristina M. Allen, Hopkinton, MA (US); Anthony Anisowicz, West Newton, MA (US); Veronique Damagnez, Framingham, MA (US); John A. Robinson, Downington, PA (US); Paul J. Yaworsky, Rockland, MA (US); Bheem M. Bhat, West Chester, PA (US)

(73) Assignees: Wyeth, Madison, NJ (US); Oscient Pharmaceuticals Corporation, Waltham, MA (US)

(*) Notice: Subject to any disclaimer, the term of this patent is extended or adjusted under 35 U.S.C. 154(b) by 138 days.

(21) Appl. No.: 11/655,924

(22) Filed: Jan. 22, 2007

(65) Prior Publication Data

US 2007/0128187 A1   Jun. 7, 2007

Related U.S. Application Data

(62) Division of application No. 10/182,936, filed as application No. PCT/US02/15982 on May 17, 2002.

(60) Provisional application No. 60/291,311, filed on May 17, 2001, provisional application No. 60/353,058, filed on Feb. 1, 2002, provisional application No. 60/361,293, filed on Mar. 4, 2002.

(51) Int. Cl.
*A61K 39/395* (2006.01)

(52) U.S. Cl. .............. 424/139.1; 424/130.1; 424/133.1; 424/141.1; 424/145.1; 424/136.1

(58) Field of Classification Search ........................ None
See application file for complete search history.

(56) References Cited

U.S. PATENT DOCUMENTS

| 5,691,153 | A | 11/1997 | Recker et al. |
| 6,673,549 | B1 | 1/2004 | Furness et al. |
| 6,844,422 | B1 | 1/2005 | Niehrs et al. |
| 6,962,797 | B2 | 11/2005 | Goddard et al. |
| 7,057,017 | B2 | 6/2006 | McCarthy |
| 7,138,508 | B2 * | 11/2006 | Niehrs et al. ............... 536/23.1 |
| 2003/0165501 | A1 | 9/2003 | DeAlmeida et al. |
| 2004/0029150 | A1 | 2/2004 | Alsobrook, II et al. |
| 2004/0234515 | A9 | 11/2004 | McCarthy |
| 2005/0069915 | A1 | 3/2005 | McCarthy |
| 2006/0294605 | A1 * | 12/2006 | McCarthy ..................... 800/14 |

FOREIGN PATENT DOCUMENTS

| DE | 19747418 | 7/1999 |
| WO | WO 97/12903 | 4/1997 |
| WO | WO 98/46743 | 10/1998 |
| WO | WO 98/46755 | 10/1998 |
| WO | WO 99/09054 | 2/1999 |
| WO | WO 99/22000 | 3/1999 |
| WO | WO 99/46281 | 9/1999 |
| WO | WO 99/47529 | 9/1999 |
| WO | WO 00/52047 A | 9/2000 |
| WO | WO 00/53756 | 9/2000 |
| WO | WO 01/92891 A2 | 12/2001 |
| WO | WO 02/16553 A2 | 2/2002 |
| WO | WO 02/066509 A | 8/2002 |
| WO | WO 02/092000 A2 | 11/2002 |

OTHER PUBLICATIONS

Janeway et al., 2001, Immunobiology, Garland Publishing, New York, Figure 10.25.*
Janeway et al., 2001, Immunobiology, Garland Publishing, New York, Chapter 3 section titled "The structure of a typical antibody molecule".*
Glinka et al., "Dickkopf-1 is a Member of a New Family of Secreted Proteins and Functions in Head Induction," Nature, vol. 391, No. 6665, pp. 357-362, MacMillan Journals Ltd., London , (2002).
Supplementary Partial European Search Report dated Nov. 19, 2004, from European Application No. EP 02 74 4162.
Gong et al., "LDL Receptor-Related Protein 5 (LRP5) Affects Bone Accrual and Eye Development," Cell, vol. 107, pp. 513-523, Cell Press, Cambridge, Massachusetts, 2001.
Magoori et al., "Severe Hypercholesterolemia, Impaired Fat Tolerance, and Advanced Atherosclerosis in Mice Lacking Both Low Density Lipoprotein Receptor-Related Protein 5 and Apolipoprotein E*," The Journal of Biological Chemistry, vol. 278, No. 13, pp. 11331-11336, The American Society for Biochemistry and Molecular Biology, Inc., Baltimore, Maryland, 2003.
Boyden et al., "High Bone Density Due to a Mutation in LDL-Receptor-Related Protein 5," The New England Journal of Medicine 346(20), pp. 1513-1521, Massachusetts Medical, Boston, Massachusetts, 2002.
Van Wesenbeeck et al., "Six Novel Missense Mutations in the LDL Receptor-Related Protein 5 (LRP5) Gene in Different Conditions with an Increased Bone Density," Am. J. Human, Genet., vol. 72, pp. 763-771, The University of Chicago Press, Chicago, Illinois, 2003.
Babij et al., "High Bone Mass in Mice Expressing a Mutant LRP5 Gene," Journal of Bone and Mineral Research, vol. 18, pp. 960-974, Mary Ann Liebert, New York, 2003.

(Continued)

*Primary Examiner*—David S Romeo
*Assistant Examiner*—Daniel C Gamett
(74) *Attorney, Agent, or Firm*—Drinker Biddle & Reath LLP

(57) ABSTRACT

The present invention provides reagents, compounds, compositions, and methods relating to novel interactions of the extracellular domain of LRP5, HBM (a variant of LRP5), and/or LRP6 with Dkk, including Dkk-1. The various nucleic acids, polypeptides, antibodies, assay methods, diagnostic methods, and methods of treatment of the present invention are related to and impact on Dkk, LRP5, LRP6, HBM, and Wnt signaling. Dkk, LRP5, LRP6, HBM, and Wnt are implicated in bone and lipid cellular signaling. Thus, the present invention provides reagents and methods for modulating lipid levels and/or bone mass and is useful in the treatment and diagnosis of abnormal lipid levels and bone mass disorders, such as osteoporosis.

25 Claims, 33 Drawing Sheets

OTHER PUBLICATIONS

Mizuguchi et al., "*LRP5, Low-Density-Lipoprotein-Receptor-Related Protein 5, is a Determinant for Bone Mineral Density*," J. Hum. Genet., vol. 49, pp. 80-86, Springer Verlag, Tokyo, Japan, 2004.

Yoganathan et al., "*Integrin-Linked Kinase (ILK): A "Hot" Therapeutic Target*," Biochemical Pharmacology, vol. 60, pp. 1115-1119, 2000.

Masaki Kato et al., "*Cbfa 1-Independent Decrease in Osteoblast Proliferation, Osteopenia, and Persistent Embryonic Eye Vascularization in Mice Deficient in Lrp5, a Wnt Coreceptor*," The Journal of Cell Biology, vol. 157, No. 2, Apr. 15, 2002, pp. 303-314, The Rockefeller University Press, USA.

Anna Bafico et al., "*Novel Mechanism of Wnt Signaling Inhibition Mediated by Dickkopf-1 Interaction with LRP6/Arrow*," Nature Cell Biology, vol. 3, Jul. 2001, pp. 683-686, Nature Publishing Group, Hampshire, United Kingdom.

Paolo Fedi, "*Isolation and Biochemical Characterization of the Human Dkk-1 Homologue, a Novel Inhibitor of Mammalian Wnt Signalling*," The Journal of Biological Chemistry, vol. 274, No. 27, pp. 19465-19472, American Society for Biochemistry and Molecular Biology, Bethesda, Maryland, USA.

Lars Grotewold et al., "*Expression Pattern of Dkk-1 During Mouse Limb Development*," Mechanisms of Development, vol. 89, Aug. 2, 1999, pp. 151-153, Elsevier Science, Oxford, United Kingdom.

Lars Grotewold et al., "*The Wnt Antagonist Dickkopf-1 is Regulated by Bmp Signaling and C-Jun and Modulates Programmed Cell Death*," The EMBO Journal, vol. 21, No. 5, pp. 966-975, 2002, Oxford University Press, USA.

Valery E. Krupnik et al., "*Functional and Structural Diversity of the Human Dickkopf Gene Family*," Gene, vol. 238 (1999), pp. 301-313, Elsevier Science, Oxford, United Kingdom.

Nan Sook Lee, "*Expression of Small Interfering RNAs Targeted Against HIV-1 Rev Transcripts in Human Cells*," Nature Biotechnology, vol. 19, pp. 500-505, May 2002, Nature Publishing Group, Hampshire, United Kingdom.

Lin Li et al., "*Second Cysteine-Rich Domain of Dickkopf 2 Activates Canonical Wnt Signaling Pathway Via LRP-6 Independently of Dishevelled*," The Journal of Biological Chemistry, vol. 277, No. 8, pp. 5977-5981, Feb. 2002, American Society for Biochemistry and Molecular Biology, USA.

Bingyu Mao et al., "*LDL-Receptor-Related Protein 6 is a Receptor for Dickkopf Proteins*," Nature, vol. 411, pp. 321-325, May 2001, Nature Publishing Group, Hampshire, United Kingdom.

Makoto Miyagishi et al., "*U6 promoter-Driven siRNAs with Four Uridine 3' Overhangs Efficiently Suppress Targeted Gene Expression in Mammalian Cells*," Nature Biotechnology, vol. 19, pp. 497-500, May 2002, Nature Publishing Group, Hampshire, United Kingdom.

Roel Nusse, "*Making Head or Tail of Dickkopf*," Nature, vol. 411, pp. 255-325, May 17, 2001, Nature Publishing Group, Hampshire, United Kingdom.

Patrick J. Paddison et al., "*Short Hairpin RNAs (shRNAs) Induce Sequence-Specific Silencing in Mammalian Cells*," Genes & Development, vol. 16, pp. 948-958, Mar. 2002, Cold Spring Harbor Laboratory Press, New York, USA.

Cynthia P. Paul et al., "*Effective Expression of Small Interfering RNA in Human Cells*," Nature Biotechnology, vol. 29, pp. 505-508, Nature Publishing Group, Hampshire, United Kingdom.

Minori Shinya et al., "*Zebrafish Dkk1, Induced by the Pre-MBT Wnt Signaling, is Secreted from the Prechordal Plate and Patterns the Anterior Neural Plate*," Mechanisms of Development, vol. 98, pp. 3-17, Jun. 2000, Elsevier Science, Oxford, United Kingdom.

Jiang Shou et al., "*Human Dkk-1, a Gene Encoding a Wnt Antagonist, Responds to DNA Damage and its Overexpression Sensitizes Brain Tumor Cells to Apoptosis Following Alkylation Damage of DNA*," Oncogene, vol. 21, pp. 878-889, 2002, Nature Publishing Group, Hampshire, United Kingdom.

Thomas Tuschl, "*Expanding Small RNA Interference*," Nature Biotechnology, vol. 20, pp. 446-448, May 2002, Nature Publishing Group, Hampshire, United Kingdom.

Jian Wang et al., "*Dickkopf-1, an Inhibitor of the Wnt Signaling Pathways, is Induced by P53*," Oncogene, vol. 19, pp. 1843-1848, Jan. 2000, Nature Publishing Group, Hampshire, United Kingdom.

Wei Wu et al., "*Mutual Antagonism Between Dickkopf-1 and Dickkopf-2 Regulates Wnt/B-Catenin Signalling*," Current Biology, vol. 10, pp. 1611-1614, 2000, Elsevier Science, USA.

Jenn-Yah Yu, "*RNA Interference by Expression of Short-Interfering RNAs and Hairpin RNAs in Mammalian Cells*," Proc. Nat'l Acad. Sci., vol. 99, No. 9, pp. 6047-6052, Apr. 30, 2002, National Academy of Sciences, Washington, D.C. USA.

Sheryl D. Brown et al., "*Isolation and Characterization of LRP6, a Novel Member of the Low Density Lipoprotein Receptor Gene Family*," Biochemical and Biophysical Research Communications, vol. 248, Article No. RC989061, pp. 879-888, 1998, Academic Press, USA.

David Chen et al., "*Molecular Cloning of Mouse Lrp7(Lr3) cDNA and Chromosomal Mapping of Orthologous Genes in Mouse and Human*," Genomics, vol. 55, pp. 314-321, 1999, Academic Press, USA.

Yu Dong et al., "*Molecular Cloning and Characterization of LR3, a Novel LDL Receptor Family Protein with Mitogenic Activity*," Biochemical and Biophysical Research Communication, vol. 251, Article No. RC989545, pp. 784-790, 1998, Academic Press, USA.

Patricia J. Hey et al., "*Cloning of a Novel Member of the Low-Density Lipoprotein Receptor Family*," Gene, vol. 216, pp. 103-111, 1998, Elsevier Science, Oxford, United Kingdom.

Dong-Ho Kim et al., "*A New Low Density Lipoprotein Receptor Related Protein, LRP5, is Expressed in Hepatocytes and Adrenal Cortex, and Recognizes Apolipoprotein E1*," J. Biochem., vol. 124, pp. 1072-1076, 1998, America Society for Biochemistry and Molecular Biology, Maryland, USA.

D. L. Koller et al., "*Linkage of a QTL Contributing to Normal Variation in Bone Mineral Density to Chromosome 11q12-13*", Journal of Bone and Mineral Research, vol. 13, No. 12, 1998, American Society for Bone and Mineral Research, USA.

Bingyu Mao et al., "*Kremen Proteins are Dickkopf Receptors that Regulate Wnt/B-Catenin Signalling*," Nature, vol. 756, pp. 1-4, 2002, Nature Publishing Group, Hampshire, United Kingdom.

Junhao Mao et al., "*Low-Density Lipoprotein Receptor-Related Protein-5 Binds to Axin and Regulates the Canonical Wnt Signaling Pathway*," Molecular Cell, vol. 7, pp. 801-809, Apr. 2001, Cell Press, Cambridge, Massachusetts, USA.

Yusuke Nakagawa et al., "*Fine Mapping of the Diabetes-Susceptibility Locus, IDDM4, on Chromosome 11q13*," Am. J. Human Genet., vol. 63, pp. 547-556, 1998, The University of Chicago Press, Chicago, Illinois, USA.

Editorial, "*Regulation of Bone Formation and Vision by LRP5*," New England Journal of Medicine, vol. 346, No. 20, May 16, 2002, Massachusetts Medical Society, Boston, Massachusetts, USA.

Kathleen I. Pinson et al., "*An LDL-Receptor-Related Protein Mediates Wnt Signalling in Mice*," Nature, vol. 407, pp. 535-538, Sep. 2000, Nature Publishing Group, Hampshire, United Kingdom.

Keiko Tamai et al., "*LDL-Receptor-Related Proteins in Wnt Signal Transduction*," Nature, vol. 407, pp. 530-535, Sep. 2000, Nature Publishing Group, Hampshire, United Kingdom.

Marcel Wehrli et al., "*Arrow Encodes an LDL-Receptor-Related Protein Essential for Wingless Signaling*," Nature, vol. 407, pp. 527-530, Sep. 2000, Nature Publishing Group, Hampshire, United Kingdom.

Christof Niehrs et al., "*Dickkopf-1 and the Spemann-Mangold Head Organizer*," Int. J. Devel. Biol., vol. 45, pp. 237-240, 2001, UBC Press, Spain.

Isao Nozaki et al., "*Reduced Expression of RE1C/Dkk-3 Gene in Non-Small Cell Lung Cancer*," International Journal of Oncology, vol. 19, pp. 117-121, 2001, Lychnia Athens, Greece.

L. Aravind et al., "*A Colipase Fold in the Carboxy-Terminal Domain of the Wnt Antagonists—the Dickkopfs*," Current Biol. Jul. 1998, vol. 8, No. 14, pp. R477-R478, Elsevier Science, USA.

Tim H. Szeto et al., "*Isolation of a Funnel-Web Spider Polypeptide with Homology Tomamba Intestinal Toxin 1 and the Embryonic Head Inducer Dickkopf-1*," Toxicon, Mar. 2000, vol. 38, No. 3, pp. 429-442, Pergamon Press, USA.

H. Van Tilbeurgh et al., "*Colipase: Structure and Interaction with Pancreatic Lipase*," Biochem Biophys Acta, Nov. 1999, vol. 1441, Nos. 2-3, pp. 173-184, Elsevier Science, Oxford, United Kingdom.

Mahua Mukhopadhyay et al., "*Dickkopf1 is Required for Embryonic Head Induction and Limb Morphogenesis in the Mouse*," Developmental Cell, vol. 1, pp. 423-434, Sep. 2001, Cell Press, Cambridge, Massachusetts, USA.

Mikhail V. Semenov et al., "*Head Inducer Dickkopf-1 is a Ligand for Wnt Coreceptor LRP6*", Current Biol., Jun. 2001, vol. 11, No. 12, pp. 951-961, Elsevier Science, USA.

Martha J. Marvin et al., "*Inhibition of Wnt Activity Induces Heart Formation from Posterior Mesoderm*," Genes & Development, Feb. 2001, vol. 15, No. 3, pp. 316-327, Cold Spring Harbor Laboratory Press, New York, USA.

Thomas Andl et al., "*WNT Signals are Required for the Initiation of Hair Follicle Development*," Development Cell, vol. 2, pp. 643-653, May 2002, Cell Press, Cambridge, Massachusetts, USA.

Mao et al., "*LDL-receptor-related protein 6 is a receptor for Dickkopf proteins*," Nature vol. 411, pp. 321-325, May 17, 2001.

Toshiya Tsuji et al., "*Antiproliferative Activity of REICDkk-3 and its Significant Down-Regulation in Non-Small-Cell Lung Carcinomas*," Biochemical and Biophysical Research Communications, vol. 289, pp. 257-263, 2001, Academic Press, NY, USA.

L. C. Kao et al., "*Global Gene Profiling in Human Endometrium During the Window of Implantation*," Endocrinology, vol. 143, No. 6, pp. 2119-2138, The Endocrine Society, USA.

A. Paula Monoghan et al., "*Dickkopf Genes are Co-Ordinately Expressed in Mesodermal Lineages*," Mechanisms of Development, vol. 87, pp. 45-56, 1999, Elsevier Science, Ireland.

Hisashi Hashimoto et al., "*Zebrafish Dkk1 Functions in Forebrain Specification and Axial Mesendoderm Formation*," Developmental Biology, vol. 217, pp. 138-152, 2000, Academic Press, New York, USA.

Annex Form PCT/ISA/206 Communication Relating to the Results of the Partial International Search attached to Invitation to Pay Additional Fees dated May 7, 2001 in PCT/US00/16951 filed on Jun. 21, 2000.

A. Courseaux et al., "*Homo sapiens Chromosome 11 Clone BAC67-M-5 MAP 11q13, \*\*\* Sequencing in Progress \*\*\*, 3 Ordered Pieces*," Database EM_HTG, E.B.I., Hinxton, U.K., Accession No. AC024123, Mar. 2, 2000, XP002165276, Abstract.

Michael P. Whyte, "*Searching for Gene Defects that Cause High Bone Mass*," Am. J. Hum. Genet., vol. 60: No. 6, pp. 1309-1311, Jun. 1997, The University of Chicago Press, Chicago, Illinois, USA.

Marion Trommsdorff et al., "*Interaction of Cytosolic Adaptor Proteins with Neuronal Apolipoprotein E Receptors and the Amyloid Precursor Protein*," J. Biol. Chem., vol. 273, No. 50, pp. 33556-33560, Dec. 1998, The American Society for Biochemistry and Molecular Biology, Inc., Bethesda, Maryland, USA.

G. Schneider et al., "*Formation of Focal Adhesions by Osteoblasts Adhering to Different Substrata*," Experimental Cell Research, vol. 214, No. 1, pp. 264-269, Sep. 1994, Academic Press, Inc., New York, USA.

Frederick M. Pavalko et al., "*Fluid Shear-Induced Mechanical Signaling in MC3T3-E1 Osteoblasts Requires Cytoskeleton-Integrin Interactions*," Am. J. Physiol., vol. 275, No. 6 (Pt1), pp. C1591-C1601, Dec. 1998, The American Physiological Society, USA.

Mark L. Johnson et al., "*Linkage of a Gene Causing High Bone Mass to Human Chromosome 11 (11q12-13)*," Am. J. Hum. Genet., vol. 60, No. 6, pp. 1326-1332, Jun. 1997, The University of Chicago Press, Chicago, Illinois, USA.

Randall D. Little et al., "*A Mutation in the LDL Receptor-Related Protein 5 Gene Results in the Autosomal Dominant High-Bone-Mass Trait*," The American Journal of Human Genetics, vol. 70, No. 1, pp. 11-19, Jan. 2002, by The University of Chicago Press, Chicago, USA.

Julian Zielenski, "*Genotype and Phenotype in Cystic Fibrosis*," Respiration, vol. 67, pp. 117-133, 2000, by S. Karger AG, Basel.

Web Page, Abstract for Research News, "*Researchers Discover 'Thermostat' that Regulates Bone Density*," Howard Hughes Medical Institute, Nov. 16, 2001, Chevy Chase, Maryland. At http://www.hhmi.org/news/warman.html, Accessed: Apr. 9, 2002.

Rodan et al., "*Therapeutic Approaches to Bone Diseases*," 2000, Science, vol. 289, pp. 1508-1514, American Association for the Advancement of Science with the assistance of Stanford University's Highwire Press, USA.

Kundu et al., "*Role of Polypeptides in the Treatment and Diagnosis of Osteoporosis*," 1999, Peptides, vol. 20, pp. 523-537, Elsevier Science, Oxford, United Kingdom.

Ziegler et al., "*Glucocorticoid-Induced Osteoporosis: Prevention and Treatment*," 1998, Steroids, vol. 63, pp. 344-348, Elsevier Science, USA.

Bollag et al., "*Osteoblast-Derived Cells Express Functional Glucose-Dependent Insulinotropic Peptide Receptors*," 2000, Endocrinology, vol. 141, pp. 1228-1235, The Endocrine Society, USA.

Tate et al., "*Human Dickkopf as well as DAN Family Members, Cerberus and Gremlin, are Preferentially Expressed in Epithelial Malignant Cell Lines*," 1999, J. Biochem. Mol. Bio. Biophys., vol. 3, pp. 329-342 (1999).

Hillier et al., "*Generation and Analysis of 280,000 Human Expressed Sequence Tags*" 1996, Genome Research, vol. 6, No. 9, pp. 807.

Brott, "*Regulation of Wnt/LRP Signaling by Distinct Domains of Dickkopf Proteins*" Mol. Cell. Biol., vol. 22, No. 17, pp. 6100-6110 (Sep. 2002).

K.A. Wharton, "*REVIEW Runnin' with the Dvl: Proteins That Associate with Dsh/Dv; and Their Significance to Wnt Signal Transduction*" Dev. Biol., vol. 253, No. 1, pp. 1-17, (Jan. 2003).

International Search Report dated Aug. 10, 2004, from International PCT Application No. PCT/US02/14877.

Aaron Zorn. Wnt signaling: Antagonistic Dickkopfs. Current Biology 2001, vol. 11, No. 15, pp. R592-R595. Elsevier Science Ltd., Oxford, UK.

International Search Report mailed Aug. 8, 2003, from International PCT Application No. PCT/US02/15982.

Kim et al., "*Homo sapien LRP5 mRNA for Lipoprotein Receptor Related Protein 5*," Database Accession No. AB017498, at http://www.ncbi.nlm.nih.giv/entrez/viewer.fcgi?db=nuccore&id-3582144 (Sep. 16, 1998).

Partial European Search Report mailed Jul. 25, 2008, in European Application No. EP 08 00 6373.

Figueroa et al., "*Expression of the Type I Diabetes-associated Gene LRP5 in Macrophages, Vitamin A System Cells, and the Islets of Langerhans Suggests Multiple Potential Roles in Diabetes*," The Journal of Histochemistry & Cytochemistry, vol. 48(10); 2000, pp. 1357-1368.

European Search Report dated Aug. 7, 2009, issued in European Application No. 02 744 162.5.

\* cited by examiner

Model of Wnt signaling

Sequence of baits used in Y2H screens
>DKK1    (SEQ ID NO: 168)

AATTCCAACGCTATCAAGAACCTGCCCCCACCGCTGGGCGGCGCTG
CGGGGCACCCAGGCTCTGCAGTCAGCGCCGCGCCGGGAATCCTGTA
CCCGGGCGGGAATAAGTACCAGACCATTGACAACTACCAGCCGTAC
CCGTGCGCAGAGGACGAGGAGTGCGGCACTGATGAGTACTGCGCT
AGTCCCACCCGCGGAGGGGACGCGGGCGTGCAAATCTGTCTCGCCT
GCAGGAAGCGCCGAAAACGCTGCATGCGTCACGCTATGTGCTGCCC
CGGGAATTACTGCAAAAATGGAATATGTGTGTCTTCTGATCAAAAT
CATTTCCGAGGAGAAATTGAGGAAACCATCACTGAAAGCTTTGGTA
ATGATCATAGCACCTTGGATGGGTATTCCAGAAGAACCACCTTGTC
TTCAAAAATGTATCACACCAAAGGACAAGAAGGTTCTGTTTGTCTC
CGGTCATCAGACTGTGCCTCAGGATTGTGTTGTGCTAGACACTTCTG
GTCCAAGATCTGTAAACCTGTCCTGAAAGAAGGTCAAGTGTGTACC
AAGCATAGGAGAAAAGGCTCTCATGGACTAGAAATATTCCAGCGTT
GTTACTGTGGAGAAGGTCTGTCTTGCCGGATACAGAAAGATCACCA
TCAAGCCAGTAATTCTTCTAGGCTTCACACTTGTCAGAGACACTAA

FIG. 2A

>zmax1 LBD1  (SEQ ID NO: 169)

CTCATCCTGCCCCTGCATGGACTGAGGAACGTCAAAGCCATCGACTAT
GACCCACTGGACAAGTTCATCTACTGGGTGGATGGGCGCCAGAACATC
AAGCGAGCCAAGGACGACGGGACCCAGCCCTTTGTTTTGACCTCTCTG
AGCCAAGGCCAAAACCCAGACAGGCAGCCCCACGACCTCAGCATCGA
CATCTACAGCCGGACACTGTTCTGGACGTGCGAGGCCACCAATACCAT
CAACGTCCACAGGCTGAGCGGGGAAGCCATGGGGGTGGTGCTGCGTG
GGGACCGCGACAAGCCCAGGGCCATCGTCGTCAACGCGGAGCGAGGG
TACCTGTACTTCACCAACATGCAGGACCGGGCAGCCAAGATCGAACGC
GCAGCCCTGGACGGCACCGAGCGCGAGGTCCTCTTCACCACCGGCCTC
ATCCGCCCTGTGGCCCTGGTGGTAGACAACACACTGGGCAAGCTGTTC
TGGGTGGACGCGGACCTGAAGCGCATTGAGAGCTGTGACCTGTCAGG
GGCCAACCGCCTGACCCTGGAGGACGCCAACATCGTGCAGCCTCTGGG
CCTGACCATCCTTGGCAAGCATCTCTACTGGATCGACCGCCAGCAGCA
GATGATCGAGCGTGTGGAGAAGACCACCGGGGACAAGCGGACTCGCA
TCCAGGGCCGTGTCGCCCACCTCACTGGCATCCATGCAGTGGAGGAAG
TCAGCCTGGAGGAGTTCTCAGCCCACCCATGTGCCCGTGACAATGGTG
GCTGCTCCCACATCTGTATTGCCAAGGGTGATGGGACACCACGGTGCT
CATGCCCAGTCCACCTCGTGCTCCTGCAGAACCTGCTGACCTGTGGAG
AGCCGCCCACCTGCTCCCCGGACCAGTTTGCATGTGCCACAGGGGAGA
TCGACTGTATCCCCGGGGCCTGGCGCTGTGACGGCTTTCCCGAGTGCG
ATGACCAGAGCGACGAGGAGGGCTGCCCCGTGTGCTCCGCCGCCCAGT
TCCCCTGCGCGCGGGGTCAGTGTGTGGACCTGCGCCTGCGCTGCGACG
GCGAGGCAGACTGTCAGGACCGCTCAGACGAGGCGGACTGTGACGCC
ATCTGCCTGCCCAACCAGTTCCGGTGTGCGAGCGGCCAGTGTGTCCTC
ATCAAACAGCAGTGCGACTCCTTCCCCGACTGTATCGACGGCTCCGAC
GAGCTCATGTGTGAAATCACCAAGCCGCCC

FIG. 2B

>zmax1 LBD4    (SEQ ID NO: 170)

AGGGCCATCGTCGTCAACGCGGAGCGAGGGTACCTGTACTTCACCAA
CATGCAGGACCGGGCAGCCAAGATCGAACGCGCAGCCCTGGACGGCA
CCGAGCGCGAGGTCCTCTTCACCACCGGCCTCATCCGCCCTGTGGCCC
TGGTGGTAGACAACACACTGGGCAAGCTGTTCTGGGTGGACGCGGAC
CTGAAGCGCATTGAGAGCTGTGACCTGTCAGGGGCCAACCGCCTGAC
CCTGGAGGACGCCAACATCGTGCAGCCTCTGGGCCTGACCATCCTTGG
CAAGCATCTCTACTGGATCGACCGCCAGCAGCAGATGATCGAGCGTG
TGGAGAAGACCACCGGGGACAAGCGGACTCGCATCCAGGGCCGTGTC
GCCCACCTCACTGGCATCCATGCAGTGGAGGAAGTCAGCCTGGAGGA
GTTCTCAGCCCACCCATGTGCCCGTGACAATGGTGGCTGCTCCCACAT
CTGTATTGCCAAGGGTGATGGGACACCACGGTGCTCATGCCCAGTCCA
CCTCGTGCTCCTGCAGAACCTGCTGACCTGTGGAGAGCCGCCCACCTG
CTCCCCGGACCAGTTTGCATGTGCCACAGGGGAGATCGACTGTATCCC
CGGGGCCTGGCGCTGTGACGGCTTTCCCGAGTGCGATGACCAGAGCG
ACGAGGAGGGCTGCCCCGTGTGCTCCGCCGCCCAGTTCCCCTGCGCGC
GGGGTCAGTGTGTGGACCTGCGCCTGCGCTGCGACGGCGAGGCAGAC
TGTCAGGACCGCTCAGACGAGGCGGACTGTGACGCCATCTGCCTGCC
CAACCAGTTCCGGTGTGCGAGCGGCCAGTGTGTCCTCATCAAACAGC
AGTGCGACTCCTTCCCCGACTGTATCGACGGCTCCGACGAGCTCATGT
GTGAAATCACCAAGCCGCCCTAAGCGGCCGC

FIG. 2C

Screen of DKK1 X Peptide Library

| name | motif | # hits | SEQ ID NO: |
|---|---|---|---|
| 252-1 | SVGCLLCAGLGVWSLS | 3 | 171 |
| 252-2 | WCCCGLFRGVCVWSCGADD | 2 | 172 |
| 252-3 | GWRRCDWCGCVSWCWV | 1 | 173 |
| 252-4 | MPGSVSHCWGGICEAL | 8 | 174 |
| 252-15 | SCCAVDVCLRCGGWFR | 1 | 175 |
| 252-16 | SVLGTCCCCGGWILCE | 2 | 176 |
| 252-17 | VLSVCEVCGGVFVRRC | 1 | 177 |
| 252-18 | GMWYWSGRDCALCWL | 1 | 178 |
| 252-19 | CTAVMWGVGSVAYLGE | 1 | 179 |
| 252-20 | WCWWCGCRGVVWR | 1 | 180 |
| 252-21 | CVCASFCCCVCGLRLL | 1 | 181 |
| 252-23 | TYEVCEECGGRVRMWV | 6 | 182 |
| 252-25 | VVVCASCGQVWHGSGA | 2 | 183 |
| 252-26 | CCRCCHCWDCEWHMCV | 1 | 184 |
| 252-27 | FCASCCWCGCDCFGWV | 2 | 185 |
| 252-32 | CDYCWSCGVWCPSSWL | 3 | 186 |
| 252-47 | VYLCVWCGAARFGCYG | 1 | 187 |
| 252-48 | FCVCGCCWCWCAACWC | 1 | 188 |

FIG. 3

| peptide # | peptide seq | # hits | SEQ ID NO: |
|---|---|---|---|
| 9 | VVLCSRCGRLWRWSCG | 1 | 189 |
| 12 | EVRQVTCIRCRRGFLL | 1 | 190 |
| 13 | GGGGMWEAWSCYACG | 1 | 191 |
| 14 | GWRWCGRCGALWWRRV | 3 | 192 |

FIG. 4

| Gene | Genbank Accession # | Protein Accession # |
|---|---|---|
| granulin | M75161 | AAA58617 |
| similar to cys/His rich protein | BC004544 | AAH04544 |
| IGF-BINDING PROTEIN 6 | M69054 | AAA88070 |
| latent TGFb binding protein 4 | AF051344 | AAC39879 |
| NOTCH 2 | AF315356 | AAG37073 |
| fibulin 1 | X53743 | CAA37772 |
| MDC15 (ADAM15) | U46005 | AAC51112 |
| DKFZp761G02121(notch1 Ca++ binding like) | AL137311 | CAB70690 |
| chordin | AF076612 | AAC69835 |
| fibronectin 1 | U42594 | AAD00019 |
| MG50(melanoma associated antigen) | AF200348 | AAF06354 |
| unknown (notch 4-like) | AX068260 | CAC27245 |
| Slit 1 | AB017167 | BAA35184 |
| tomoregulin (agarin repeat homology) | AB004064 | BAA90820 |
| sprouty 1 | AF041037 | AAC39566 |
| sprouty 2 | AF039843 | AAC04258 |
| NOV1 | X96584 | CAA65403 |
| agrin | AF016903 | AAC39776 |
| fibrillin 1 | L13923 | AAB02036 |
| thrombospondin1 | X04665 | CAA28370 |
| ADAM19 | AF134707 | AAF22162 |
| Nafl alpha | AJ011895 | CAA09855 |
| laminin alpha 5 | Z95636 | CAB09137 |
| CRIM1 | AF167706 | AAF34409 |
| nidogen | M30269 | AAA59932 |
| fibulin-2 | X82494 | CAA57876 |
| thrombospondin 2 | L12350 | AAA03703 |
| KIAA1323 | AB037744 | BAA92561 |
| fibrillin-2 | U03272 | AAA18950 |
| MEGF9 | AB011542 | BAA32470 |
| integrin beta 1 | X07979 | CAA30790 |
| matrilin-2 precursor | U69263 | AAC51260 |
| tenascin | X56160 | A32160 |

FIG. 5

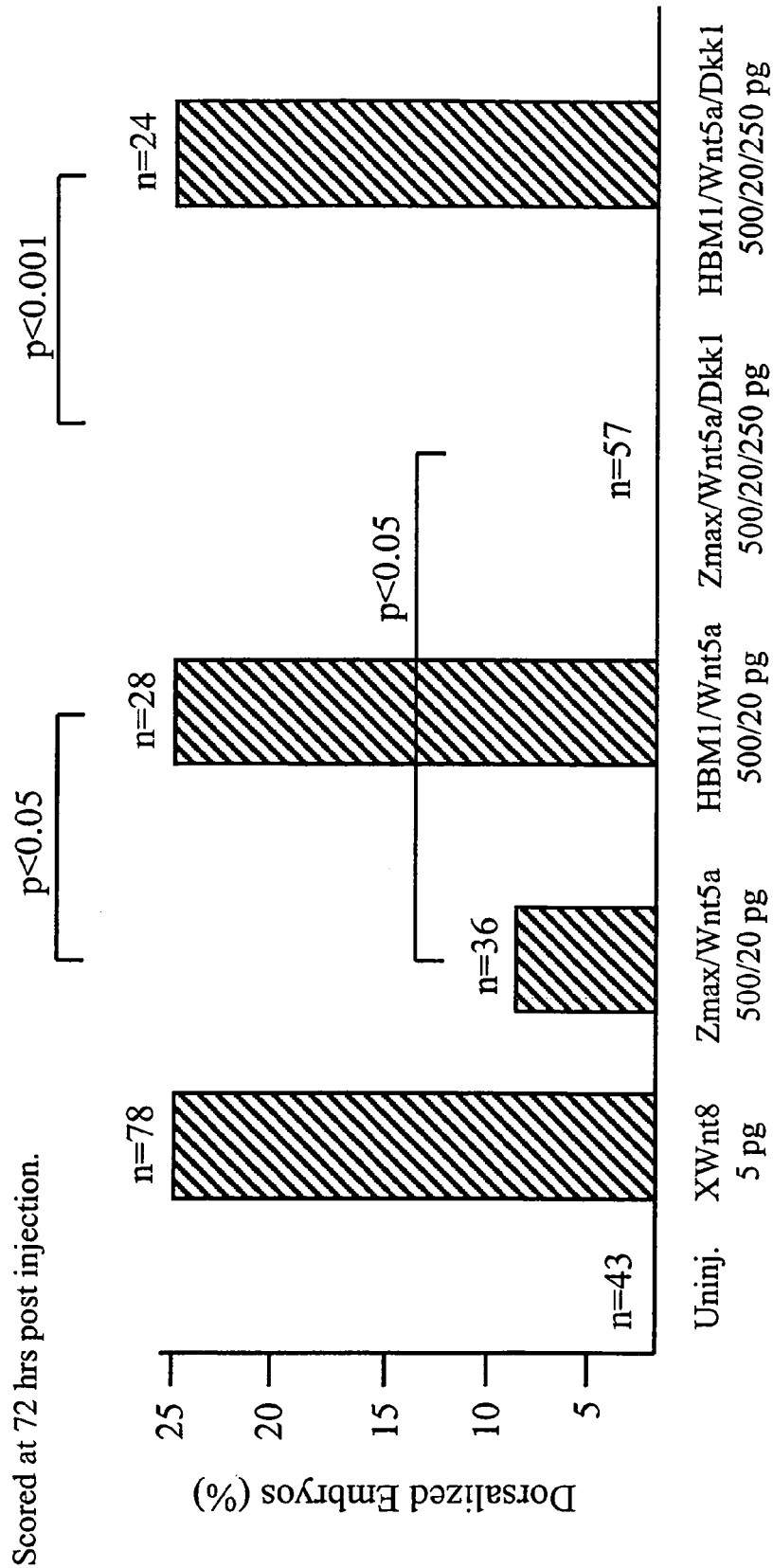

Listed are the pcDNA3.1 construct names followed by the DNA sequence

OST258 (control for OST 259-OST262 and OST264,OST265)
(SEQ ID NO: 215)
AAGCTTGCCACCATGGAGACAGACACACTCCTGCTATGGGTACTGCTGCTCTG
GGTTCCAGGTTCCACTGGTGACGGATCC OST259   (SEQ ID NO: 193)
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGTGGTTCTGTGTTCGCGTTG
TGGGCGTTTGTGGCGGTGGTCGTGTGGGACTAGTGGTCCGTGCAAAATGATCG
CCCCGATTCTGGATGAAATCGCTGACGAATATCAGGGCAAACTGACCGTTGCA
AAACTGAACATCGATCAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC OST260   (SEQ ID NO: 194)
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGGGTGGCGGTGGTGTGGTCG
GTGTGGGGCTTTGTGGTGGCGGCGTGTTACTAGTGGTCCGTGCAAAATGATCG
CCCCGATTCTGGATGAAATCGCTGACGAATATCAGGGCAAACTGACCGTTGCA
AAACTGAACATCGATCAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC OST261   (SEQ ID NO: 195)
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGAGGTGCGGCAGGTTACGTG
TATTAGGTGTCGTCGGGGTTTTCTGTTGACTAGTGGTCCGTGCAAAATGATCG
CCCCGATTCTGGATGAAATCGCTGACGAATATCAGGGCAAACTGACCGTTGCA

FIG. 12A

AAACTGAACATCGATCAAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC

OST262 (SEQ ID NO: 196)
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGGTGGTGGGGGATGATTTG
GGAGGCTTGGAGTTGTTATGCGTGTGGGACTAGTGGTCCGTGCAAAATGATCG
CCCCGATTCTGGATGAAATCGCTGACGAATATCAGGGCAAACTGACCGTTGCA
AAACTGAACATCGATCAAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC

OST263 (SEQ ID NO: 197)
AAGCTTGCCACCATGGAGACAGACACAC TCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCTTGTGGATTGGGCCGGGTGA
TCAGGGTCTGTTTCGGCGTTTTGTTTTTACTAGTGGTCCGTGCAAAATGATCG
CCCCGATTCTGGATGAAATCGCTGACGAATATCAGGGCAAACTGACCGTTGCA
AAACTGAACATCGATCAAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC

OST264 (SEQ ID NO: 198)
AAGCTTGCCACCATGGAGACAGACACACTCCTGCTATGGGTACTGCTGCTCTG
GGTTCCAGGTTCCACTGGTGACGGATCCGTGTCTTCTGATCAAAATCATTTCC
GAGGAGAAATTGAGGAAACCATCACTGAAAGCTTTGGTAATGATCATAGCACC
TTGGATGGGTATTCCAGAAGAACCACCTTGTCTTCAAAAATGTATCACACCAA
AGGACAAGAAGGTTCTGTTTGTCTCCGGTCATCAGACTGTGCCTCAGGATTGT
GTTGTGCTAGACACTTCTGGTCCAAGATCTGTAAACCTGTCCTGAAAGAAGGT
CAAGTGTGTACCAAGCATAGGAGAAAAGGCTCTCATGGACTAGAAATATTCCA
GCGTTGTTACTGTGGAGAAGGTCTGTCTTGCCGGATACAGAAAGATCACCATC
AAGCCAGTAATTCTTCTAGGCTTCACACTTGTCAGAGACACTAAGCGGCCGC

FIG. 12B

OST265  (SEQ ID NO: 199)
AAGCTTGCCACCATGGAGACAGACACACTCCTGCTATGGGTACTGCTGCTCTG
GGTTCCAGGTTCCACTGGTGACGGATCCTGCGCTAGTCCCACCCGCGGAGGGG
ACGCGGGCGTGCAAATCTGTCTCGCCTGCAGGAAGCGCCGAAAACGCTGCATG
CGTCACGCTATGTGCTGCCCCGGGAATTACTGCAAAAATGGAATATGTGTGTC
TTCTGATCAAAATCATTTCCGAGGAGAAATTGAGGAAACCATCACTGAAAGCT
TTGGTAATGATCATAGCACCTTGGATGGGTATTCCAGAAGAACCACCTTGTCT
TCAAAAATGTATCACACCAAAGGACAAGAAGGTTCTGTTTGTCTCCGGTCATC
AGACTGTGCCTCAGGATTGTGTTGTGCTAGACACTTCTGGTCCAAGATCTGTA
AACCTGTCCTGAAAGAAGGTCAAGTGTGTACCAAGCATAGGAGAAAAGGCTCT
CATGGACTAGAAATATTCCAGCGTTGTTACTGTGGAGAAGGTCTGTCTTGCTA
AGCGGCCGC

OST266  (SEQ ID NO: 200)
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCTATGCGTGGTTGTTTTCTTGTAGTAGGTGTAGGTGG
TGGTTGCCTTGGACTAGTGGTCCGTGCAAAATGATCGCCCCGATTCTGGATGA
AATCGCTGACGAATATCAGGGCAAACTGACCGTTGCAAAACTGAACATCGATC
AAAACCCTGGCACTGCGCCGAAATATGGCATCCGTGGTATCCCGACTCTGCTG
CTGTTCAAAAACGGTGAAGTGGCGGCAACCAAAGTGGGTGCACTGTCTAAAGG
TCAGTTGAAAGAGTTCCTCGACGCTAACCTGGCGTAAGCGGCCGC

OST267  (SEQ ID NO: 201)
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCATTTGTGAGGTTGTGAGGTTGTGGAGTCGGTATCCT
TGGTCTTGGGTGACTAGTGGTCCGTGCAAAATGATCGCCCCGATTCTGGATGA
AATCGCTGACGAATATCAGGGCAAACTGACCGTTGCAAAACTGAACATCGATC
AAAACCCTGGCACTGCGCCGAAATATGGCATCCGTGGTATCCCGACTCTGCTG
CTGTTCAAAAACGGTGAAGTGGCGGCAACCAAAGTGGGTGCACTGTCTAAAGG
TCAGTTGAAAGAGTTCCTCGACGCTAACCTGGCGTAAGCGGCCGC

FIG. 12C

OST268 (SEQ ID NO: 202)
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCGGTTGTACTAGTGCGGTGTGTGGTGCTTGGGCTGAG
GCGGGTAGGTTTTATTGTACTAGTGGTCCGTGCAAAATGATCGCCCCGATTCT
GGATGAAATCGCTGACGAATATCAGGGCAAACTGACCGTTGCAAAACTGAACA
TCGATCAAAACCCTGGCACTGCGCCGAAATATGGCATCCGTGGTATCCCGACT
CTGCTGCTGTTCAAAAACGGTGAAGTGGCGGCAACCAAAGTGGGTGCACTGTC
TAAAGGTCAGTTGAAAGAGTTCCTCGACGCTAACCTGGCGTAAGCGGCCGC

OST269 (SEQ ID NO: 203) (irrelevant control peptide
for OST266-OST268)
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCTTGTGGATTGGGCCGGGTGATCAGGGTCTGTTTCGG
CGTTTTGTTTTTACTAGTGGTCCGTGCAAAATGATCGCCCCGATTCTGGATGA
AATCGCTGACGAATATCAGGGCAAACTGACCGTTGCAAAACTGAACATCGATC
AAAACCCTGGCACTGCGCCGAAATATGGCATCCGTGGTATCCCGACTCTGCTG
CTGTTCAAAAACGGTGAAGTGGCGGCAACCAAAGTGGGTGCACTGTCTAAAGG
TCAGTTGAAAGAGTTCCTCGACGCTAACCTGGCGTAAGCGGCCGC

FIG. 12D

Listed below are the amino acid sequences corresponding to the pcDNA3.1 constructs in Appendix 1A

OST258 (SEQ ID NO: 216)
METDTLLLWVLLLWVPGSTGDGS

OST259 (SEQ ID NO: 204)
METDTLLLWVLLLWVPGSTGDGSMSDKIIHLTDDSFDTDVLKADGAILVDFWA
EWCGPNSVVLCSRCGRLWRWSCGTSGPCKMIAPILDEIADEYQGKLTVAKLNI
DQNPGTAPKYGIRGIPTLLLFKNGEVAATKVGALSKGQLKEFLDANLA

OST260 (SEQ ID NO: 205)
METDTLLLWVLLLWVPGSTGDGSMSDKIIHLTDDSFDTDVLKADGAILVDFWA
EWCGPNSGWRWCGRCGALWWRRVTSGPCKMIAPILDEIADEYQGKLTVAKLNI
DQNPGTAPKYGIRGIPTLLLFKNGEVAATKVGALSKGQLKEFLDANLA

OST261 (SEQ ID NO: 206)
METDTLLLWVLLLWVPGSTGDGSMSDKIIHLTDDSFDTDVLKADGAILVDFWA
EWCGPNSEVRQVTCIRCRRGFLLTSGPCKMIAPILDEIADEYQGKLTVAKLNI
DQNPGTAPKYGIRGIPTLLLFKNGEVAATKVGALSKGQLKEFLDANLA

OST262 (SEQ ID NO: 207)
METDTLLLWVLLLWVPGSTGDGSMSDKIIHLTDDSFDTDVLKADGAILVDFWA
EWCGPNSGGGGMIWEAWSCYACGTSGPCKMIAPILDEIADEYQGKLTVAKLNI
DQNPGTAPKYGIRGIPTLLLFKNGEVAATKVGALSKGQLKEFLDANLA

OST263 (SEQ ID NO: 208)
METDTLLLWVLLLWVPGSTGDGSMSDKIIHLTDDSFDTDVLKADGAILVDFWA
EWCGPNSLWIGPGDQGLFRRFVFTSGPCKMIAPILDEIADEYQGKLTVAKLNI
DQNPGTAPKYGIRGIPTLLLFKNGEVAATKVGALSKGQLKEFLDANLA

OST264 (SEQ ID NO: 209)
METDTLLLWVLLLWVPGSTGDGSVSSDQNHFRGEIEETITESFGNDHSTLDGY
SRRTTLSSKMYHTKGQEGSVCLRSSDCASGLCCARHFWSKICKPVLKEGQVCT
KHRRKGSHGLEIFQRCYCGEGLSCRIQKDHHQASNSSRLHTCQRH

FIG. 13A

OST265 (SEQ ID NO: 210)
METDTLLLWVLLLWVPGSTGDGSCASPTRGGDAGVQICLACRKRRKRCMRHAM
CCPGNYCKNGICVSSDQNHFRGEIEETITESFGNDHSTLDGYSRRTTLSSKMY
HTKGQEGSVCLRSSDCASGLCCARHFWSKICKPVLKEGQVCTKHRRKGSHGLE
IFQRCYCGEGLSC.

OST266 (SEQ ID NO: 211)
MGDKIIHLTDDSFDTDVLKADGAILVDFWAEWCGPNSYAWLFSCSRCRWWLPW
TSGPCKMIAPILDEIADEYQGKLTVAKLNIDQNPGTAPKYGIRGIPTLLLFKN
GEVAATKVGALSKGQLKEFLDANLA

OST267 (SEQ ID NO: 212)
MGDKIIHLTDDSFDTDVLKADGAILVDFWAEWCGPNSICEVVRLWSRYPWSWV
TSGPCKMIAPILDEIADEYQGKLTVAKLNIDQNPGTAPKYGIRGIPTLLLFKN
GEVAATKVGALSKGQLKEFLDANLA

OST268 (SEQ ID NO: 213)
MGDKIIHLTDDSFDTDVLKADGAILVDFWAEWCGPNSGCTSAVCGAWAEAGRF
YCTSGPCKMIAPILDEIADEYQGKLTVAKLNIDQNPGTAPKYGIRGIPTLLLF
KNGEVAATKVGALSKGQLKEFLDANLA

OST269 (SEQ ID NO: 214)
MGDKIIHLTDDSFDTDVLKADGAILVDFWAEWCGPNSLWIGPGDQGLFRRFVF
TSGPCKMIAPILDEIADEYQGKLTVAKLNIDQNPGTAPKYGIRGIPTLLLFKN
GEVAATKVGALSKGQLKEFLDANLA

FIG. 13B

FIG. 17
Affinity Purified 69546/47
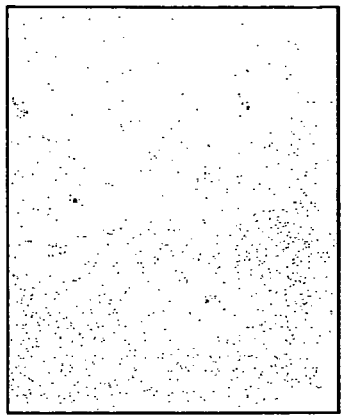
LRP5 virus infected, phase
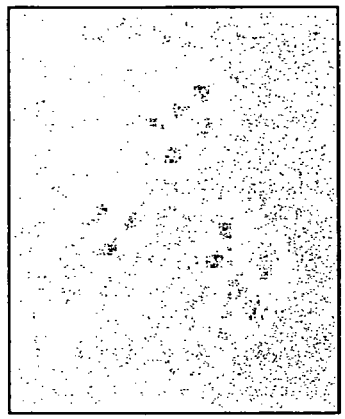
H Wnt1 - HBM generated TCF-luci is not efficiently inhibited by Dkk1 in U2-OS bone cells.

- With Wnt1 the TCF-signal generated by LRP5 is greater than that of LRP6.
- LRP5/6 -Wnt1 induced TCF- is efficiently blocked by Dkk1

FIG. 22
Aptamers 261 and 262 from the LRP5-LBD Activate Wnt Signaling in Xenopus
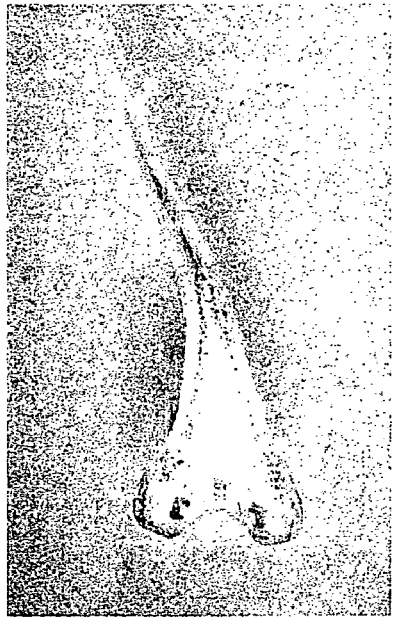
261 - LBD-Binding Peptide
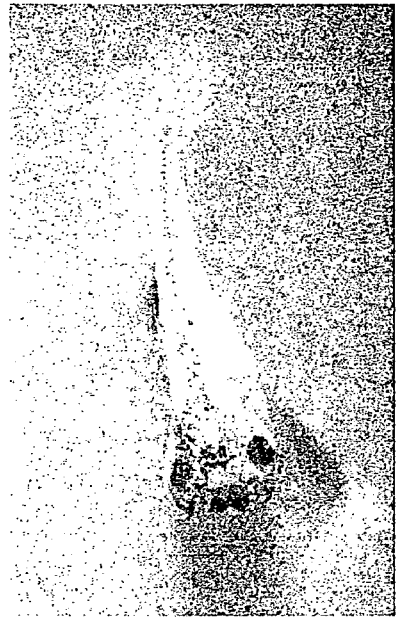
262 - LBD-Binding Peptide
263 - Negative Control
262 - LBD-Binding Peptide

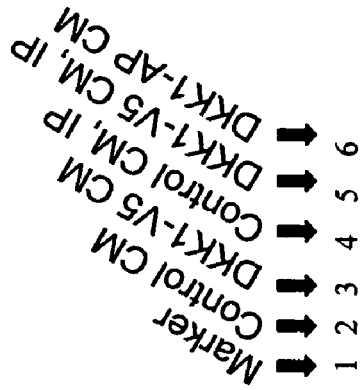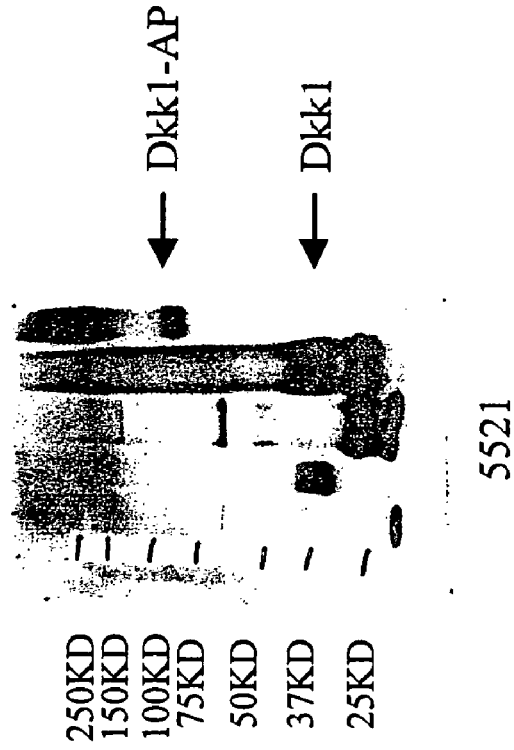
FIG. 27A
FIG. 27B

REAGENTS AND METHOD FOR MODULATING DKK-MEDIATED INTERACTIONS

CROSS REFERENCE TO RELATED APPLICATIONS

This application is a divisional application of U.S. application Ser. No. 10/182,936, filed Aug. 2, 2002, which was the National Stage of International Application No. PCT/US02/15982, May 17, 2002, which claims the benefit of U.S. Provisional Application Nos. 60/291,311, filed May 17, 2001; 60/353,058, filed Feb. 1, 2002; and 60/361,293, filed Mar. 4, 2002, all of which are herein incorporated by reference in their entirety.

FIELD OF THE INVENTION

The present invention relates to signal transduction, bone development, bone loss disorders, modulation of lipid-related conditions, research reagents, methods of screening drug leads, drug development, treatments for bone and/or lipid disorders, screening and development of therapies, molecular, cellular, and animal models of bone and/or lipid development and maintenance, which are mediated by Dkk, including Dkk-1, and/or LRP5, LRP6, HBM or other members of the Wnt pathway.

BACKGROUND OF THE INVENTION

Two of the most common types of osteoporosis are post-menopausal and senile osteoporosis. Osteoporosis affects both men and women, and, taken with other abnormalities of bone, presents an ever-increasing health risk for an aging population. The most common type of osteoporosis is that associated with menopause. Most women lose between 20-60% of the bone mass in the trabecular compartment of the bone within 3-6 years after the cessation of menses. This rapid bone loss is generally associated with an increase of bone resorption and formation. However, the resorptive cycle is more dominant and the result is a net loss of bone mass. Osteoporosis is a common and serious disease among post-menopausal women. There are an estimated 25 million women in the United States alone who are afflicted with this disease. The results of osteoporosis are personally harmful, and also account for a large economic loss due to its chronicity and the need for extensive and long-term support (e.g., hospitalization and nursing home care) from disease sequelae. This is especially true in elderly patients. Additionally, while osteoporosis is generally not thought of as a life-threatening condition, a 20-30% mortality rate is related to hip fractures in elderly women. A large percentage of this mortality rate can be directly associated with postmenopausal osteoporosis.

The most vulnerable tissue in the bone to the effects of postmenopausal osteoporosis is the trabecular bone. This tissue is often referred to as spongy bone and is particularly concentrated near the ends of the bone, near the joints, and in the vertebrae of the spine. The trabecular tissue is characterized by small structures which inter-connect with each other as well as the more solid and dense cortical tissue which makes up the outer surface and central shaft of the bone. This cris-cross network of trabeculae gives lateral support to the outer cortical structure and is critical to the biomechanical strength of the overall structure. In postmenopausal osteoporosis, it is primarily the net resorption and loss of the trabeculae which lead to the failure and fracture of the bone.

In light of the loss of the trabeculae in postmenopausal women, it is not surprising that the most common fractures are those associated with bones which are highly dependent on trabecular support, e.g., the vertebrae, the neck of the femur, and the forearm. Indeed, hip fracture, Colle's fractures, and vertebral crush fractures are indicative of postmenopausal osteoporosis. Osteoporosis affects cortical as well as trabecular bone. Alterations in endosteal bone resorption and Haversian remodeling with age affect cortical thickness and structural integrity contributing the increased risk for fracture.

One of the earliest generally accepted methods for treatment of postmenopausal osteoporosis was estrogen replacement therapy. Although this therapy frequently is successful, patient compliance is low, primarily due to the undesirable side-effects of chronic estrogen treatment. Frequently cited side-effects of estrogen replacement therapy include reinitiation of menses, bloating, depression, and, potentially, increased risk of breast or uterine cancer. In order to limit the known threat of uterine cancer in women who have not had a hysterectomy, a protocol of estrogen and progestin cyclic therapy is often employed. This protocol is similar to that used in birth control regimens, and often is not tolerated by women because of the side-effects characteristic of progestin. More recently, certain antiestrogens, originally developed for the treatment of breast cancer, have been shown in experimental models of postmenopausal osteoporosis to be efficacious. Among these agents is raloxifene (See, U.S. Pat. No. 5,393,763; Black et. al., *J. Clin. Invest.*, 93:63-69 (1994); and Ettinger et al., *JAMA* 282:637-45 (1999)). In addition, tamoxifen, a widely used clinical agent for treating breast cancer, has been shown to increase bone mineral density in post menopausal women suffering from breast cancer (Love et al., *N. Engl. J. Med.*, 326:852-856 (1992)).

Another therapy for the treatment of postmenopausal osteoporosis is the use of calcitonin. Calcitonin is a naturally occurring peptide which inhibits bone resorption and has been approved for this use in many countries (Overgaard et al., *Br. Med. J.*, 305:556-561 (1992)). The use of calcitonin has been somewhat limited, however. Its effects are very modest in increasing bone mineral density, and the treatment is very expensive. Another therapy for the treatment of postmenopausal osteoporosis is the use of bisphosphonates. These compounds were originally developed for treating Paget's disease and malignant hypercalcemia. They have been shown to inhibit bone resorption. Alendronate, a bisphosphonate, has been approved for the treatment of postmenopausal osteoporosis. These agents may be helpful in the treatment of osteoporosis, but these agents also have potential liabilities which include osteomalacia, extremely long half-life in bone (greater than 2 years),; and possible "frozen bone syndrome," e.g., the cessation of normal bone remodeling.

Senile osteoporosis is similar to postmenopausal osteoporosis in that it is marked by the loss of bone mineral density and resulting increase in fracture rate, morbidity, and associated mortality. Generally, it occurs in later life, i.e., after 70 years of age. Historically, senile osteoporosis has been more common in females, but with the advent of a more elderly male population, this disease is becoming a major factor in the health of both sexes. It is not clear what, if any, role hormones such as testosterone or estrogen have in this disease, and its etiology remains obscure. Treatment of this disease has not been very satisfactory. Hormone therapy, estrogen in women and testosterone in men, has shown equivocal results; calcitonin and bisphosphonates may be of some utility.

The peak mass of the skeleton at maturity is largely under genetic control. Twin studies have shown that the variance in bone mass between adult monozygotic twins is smaller than between dizygotic twins (Slemenda et al., *J. Bone Miner. Res.*, 6: 561-567 (1991); Young et al., *J. Bone Miner. Res.*, 6:561-567 (1995); Pocock et al., *J. Clin. Invest.*, 80:706-710 (1987); Kelly et al., *J. Bone Miner. Res.*, 8:11-17 (1993)). It has been estimated that up to 60% or more of the variance in skeletal mass is inherited (Krall et al., *J. Bone Miner. Res.*, 10:S367 (1993)). Peak skeletal mass is the most powerful determinant of bone mass in elderly years (Hui et al., *Ann. Int. Med.*, 111:355-361 (1989)), even though the rate of age-related bone loss in adult and later life is also a strong determinant (Hui et al., *Osteoporosis Int.*, 1:30-34 (1995)). Since bone mass is the principal measurable determinant of fracture risk, the inherited peak skeletal mass achieved at maturity is an important determinant of an individual's risk of fracture later in life. Thus, study of the genetic basis of bone mass is of considerable interest in the etiology of fractures due to osteoporosis.

Recently, a strong interest in the genetic control of peak bone mass has developed in the field of osteoporosis. The interest has focused mainly on candidate genes with suitable polymorphisms to test for association with variation in bone mass within the normal range, or has focused on examination of genes and gene loci associated with low bone mass in the range found in patients with osteoporosis. The vitamin D receptor locus (VDR) (Morrison et al., *Nature*, 367:284-287 (1994)), PTH gene (Howard et al., *J. Clin. Endocrinol. Metab.*, 80:2800-2805 (1995); Johnson et al., *J. Bone Miner. Res.*, 8:11-17 (1995); Gong et al., *J. Bone Miner. Res.*, 10: S462 (1995)) and the estrogen receptor gene (Hosoi et al., *J. Bone Miner. Res.*, 10: S170 (1995); Morrison et al., *Nature*, 367:284-287 (1994)) have figured most prominently in this work. These studies are difficult because bone mass (i.e, the phenotype) is a continuous, quantitative, polygenic trait, and is confounded by environmental factors such as nutrition, co-norbid disease, age, physical activity, and other factors. Also, this type of study design requires large numbers of subjects. In particular, the results of VDR studies to date have been confusing and contradictory (Garnero et al., *J. Bone Miner. Res.*, 10:1283-1288 (1995); Eisman et al., *J. Bone. Miner. Res.*, 10:1289-1293 (1995); Peacock, *J. Bone Miner. Res.*, 10:1294-1297 (1995)). Furthermore, thus far, the art has not determined the mechanism(s) whereby the genetic influences exert their effect on bone mass.

While it is well known that peak bone mass is largely determined by genetic rather than environmental factors, studies to determine the gene loci (and ultimately the genes) linked to variation in bone mass are difficult and expensive. Study designs which utilize the power of linkage analysis, e.g., sib-pair or extended family, are generally more informative than simple association studies, although the latter do have value. However, genetic linkage studies involving bone mass are hampered by two major problems. The first problem is the phenotype, as discussed briefly above. Bone mass is a continuous, quantitative trait, and establishing a discrete phenotype is difficult. Each anatomical site for measurement may be influenced by several genes, many of which may be different from site to site. The second problem is the age component of the phenotype. By the time an individual can be identified as having low bone mass, there is a high probability that their parents or other members of prior generations will be deceased and therefore unavailable for study, and younger generations may not have even reached peak bone mass, making their phenotyping uncertain for genetic analysis.

Thus, there is a need in the art for additional research tools for the elucidation of the rholecular mechanism of bone modulation, for the screening and development of candidate drugs, and for treatments of bone development and bone loss disorders. The present invention is directed to these, as well as other, important ends.

In addition to bone modulation, the present invention relates to modulation of lipid levels. Cardiovascular disease is the most common cause of mortality in the United States, and atherosclerosis is the major cause of heart disease and stroke. It is widely appreciated that cholesterol plays an important role in atherogenesis. Normally, most cholesterol serves as a structural element in the walls of cells, whereas much of the rest is in transit through the blood or functions as the starting material for the synthesis of bile acids in the liver, steroid hormones in endocrine cells and vitamin D in skin. The transport of cholesterol and other lipids through the circulatory system is facilitated by their packaging into lipoprotein carriers. These spherical particles comprise protein and phospholipid shells surrounding a core of neutral lipid, including unesterified ("free") or esterified cholesterol and triglycerides.

Risk for atherosclerosis increases with increasing concentrations of low density lipoprotein (LDL) cholesterol, whereas risk is inversely proportional to levels of high-density lipoprotein (HDL) cholesterol. The receptor-mediated control of plasma LDL levels has been well-defined, and recent studies have now provided new insights into HDL metabolism.

The elucidation of LDL metabolism began in 1974 by Michael Brown and Joseph Goldstein. In brief, the liver synthesizes a precursor lipoprotein (very low density lipoprotein, VLDL) that is converted during circulation to intermediate density lipoprotein (IDL) and then to LDL. The majority of the LDL receptors expressed in the body are on the surfaces of liver cells, although virtually all other tissues ("peripheral tissues") express some LDL receptors. After binding, the receptor-lipoprotein complex is internalized by the cells via coated pits and vesicles, and the entire LDL particle is delivered to lysosomes, wherein it is dissembled by enzymatic hydrolysis, releasing cholesterol for subsequent cellular metabolism. This whole-particle uptake pathway is called "receptor-mediated endocytosis." Cholesterol-mediated feedback regulation of both the levels of LDL receptors and cellular cholesterol biosynthesis help ensure cellular cholesterol homeostasis. Genetic defects in the LDL receptor in humans results in familial hypercholesterolemia, a disease characterized by elevated plasma LDL cholesterol and premature atherosclerosis and heart attacks. One hypothesis for the deleterious effects of excess plasma LDL cholesterol is that LDL enters the artery wall, is chemically modified, and then is recognized by a special class of receptors called macrophage scavenger receptors, that mediate the cellular accumulation of the LDL cholesterol in the artery, eventually leading to the formation of an atherosclerotic lesion.

The major lipoprotein classes include intestinally derived chylomicrons that transport dietary fats and cholesterol, hepatic-derived VLDL, IDL, and LDL that can be atherogenic, and hepatic- and intestinally-derived HDL that are antiatherogenic. Apoprotein B (ApoB) is necessary for the secretion of chylomicrons (ApoB48) and VLDL, IDL, and LDL (ApoB100). Plasma levels of VLDL triglycerides are determined mainly by the rates of secretion in LDL lipolytic activity. Plasma levels of LDL cholesterol are determined mainly by the secretion of ApoB100 into plasma, the efficacy with which VLDL are converted to LDL and by LDL receptor-mediated clearance. Regulation of HDL cholesterol levels is complex and is affected by rates of synthesis of its Apo proteins, rates of esterification of free cholesterol to cholesterol ester by LCAT, levels of triglyceride-rich lipoproteins and CETP-mediated transfer of cholesterol esters from HDL, and clearance from plasma of HDL lipids and Apo proteins.

Normal lipoprotein transport is associated with low levels of triglycerides and LDL cholesterol and high levels of HDL cholesterol. When lipoprotein transport is abnormal, lipoprotein levels can change in ways that predispose individuals to atherosclerosis and arteriosclerosis (see Ginsburg, *Endocrinol. Metab. Clin. North Am.,* 27:503-19 (1998)).

Several lipoprotein receptors may be involved in cellular lipid uptake. These receptors include: scavenger receptors; LDL receptor-related protein/$\alpha$2-macroglobulin receptor (LRP); LDL receptor; and VLDL receptor. With the exception of the LDL receptor, all of these receptors are expressed in atherosclerotic lesions while scavenger receptors are mostly expressed in macrophages, the LRP and VLDL receptors may play an important role in mediating lipid uptake in smooth muscle cells (Hiltunen et al., *Atherosclerosis,* 137 suppl.:S81-8 (1998)).

A major breakthrough in the pharmacologic treatment of hypercholesterolemia has been the development of the "statin" class of 3-hydroxy-3-methylglutaryl-CoA reductase (HMG CoA reductase) inhibitory drugs. 3-hydroxy-3-methylglutaryl-CoA reductase is the rate controlling enzyme in cholesterol biosynthesis, and its inhibition in the liver stimulates LDL receptor expression. As a consequence, both plasma LDL cholesterol levels and the risk for atherosclerosis decrease. The discovery and analysis of the LDL receptor system has had a profound impact on cell biology, physiology, and medicine.

HDL is thought to remove unesterified, or "free" cholesterol (FC) from peripheral tissues, after which most of the cholesterol is converted to cholesterol ester (CE) by enzymes in the plasma. Subsequently, HDL cholesterol is efficiently delivered directly to the liver and steroidogenic tissues via; a selective uptake pathway and the HDL receptor, SR-BI (class B type I scavenger receptor) or, in some species, transferred to other lipoproteins for additional transport in metabolism (see Krieger, *Proc. Natl. Acad. Sci. USA,* 95:4077-4080 (1998)).

These issues illustrate a need in the art for additional research tools for the elucidation of the molecular mechanism of lipid modulation, for the screening and development of candidate drugs, and for treatments of lipid levels and lipid level modulation disorders. The present invention is directed to these, as well as other, important ends.

SUMMARY OF THE INVENTION

The present invention provides reagents, compounds, compositions and methods relating to novel interactions of the extracellular domain of LRP5, HBM (a variant of LRP5), and/or LRP6 with Dkk proteins. LRP5 is also referred to as Zmax1 or Zmax. Thus, when discussing methods, reagents, compounds, and compositions of the invention which relate to the interaction between Dkk and LRP5 (or Zmax1), of the invention is also to be understood to encompass embodiments relating to interactions between Dkk and LRP6 and Dkk and HBM. Moreover, where Dkk is discussed herein, it is to be understood that the methods, reagents, compounds, and compositions of the present invention include the Dkk family members, including but not limited to Dkk-1, Dkk-2, Dkk-3, Dkk-4 and Soggy. Furthermore, the invention encompasses novel fragments of Dkk-1 which demonstrate a binding interaction between the ligand binding domain (LBD) of LRP5 and additional proteins and/or which can modulate an interaction between LRP5, or a variant or fragment thereof, and a Dkk protein. The invention provides assays, methods, compositions, and compounds relating to Dkk-Wnt signaling. Numerous Wnt proteins are compatible with the present invention, including Wnt1-Wnt19, and particularly, Wnt1, Wnt3, Wnt3a, and. Wnt10. The present invention further provides reagents, compounds, compositions and methods modulating interactions between one or more other proteins and Dkk-1. The present invention also provides a series of peptide aptamers which bind to Dkk-1 or to LRP5 (or HBM and/or LRP6).

The polypeptides of the invention, for example in the form of peptide oligomers, aptamers, proteins, and protein fragments as well as the nucleic acids of the invention, for example in the form of nucleic acids which encode the polypeptides of the invention as well as antisense, or complimentary nucleic acids, are useful as reagents for the study of bone mass and lipid level modulation. The polypeptides and nucleic acids of the invention are also useful as therapeutic and diagnostic agents.

The present invention provides useful reagents for the modulation of Dkk proteins with LRP5, LRP6, and/or HBM, the modulation Dkk-1 and/or Dkk-1 interacting protein activity, and modulation of LRP5/Dkk-1, LRP6/Dkk1 and HBM/Dkk-1 interactions and Dkk-1/Dkk-1 interacting protein interactions. The present invention provides a series of peptide aptamers which bind Dkk-1 or LRP5, LRP6, and/or HBM.

An object of the invention is to provide for a method of regulating LRP5/LRP6/HBM/HBM-like activity in a subject comprising administering a therapeutically effective amount of a composition which modulates Dkk activity. The subject can be a vertebrate or an invertebrate organism, but more preferably the organism is a canine, a feline, an ovine, a primate, an equine, a porcine, a caprine, a camelid, an avian, a bovine, or a rodent organism. A more preferred organism is a human. In a preferred embodiment, the Dkk protein is Dkk-1. In a particularly preferred embodiment, Dkk-1 activity is decreased. In another embodiment, Dkk activity modulates bone mass and/or lipid levels. In a preferred embodiment, bone mass is increased and/or lipid levels are decreased. In another preferred embodiment, the modulation in bone mass is an increase in bone strength determined via one or more of a decrease in fracture rate, an increase in areal bone density, an increase in volumetric mineral bone density, an increase in trabecular connectivity, an increase in trabecular density, an increase in cortical density or thickness, an increase in bone diameter, and an increase in inorganic bone content. The invention further provides such a method wherein the composition comprises a Dkk, Dkk-1 or a LRP5/LRP6/HBM binding fragment thereof, such as those depicted in FIG. 6 or a mimetic of those fragments depicted in FIG. 6. The invention further provides such a method wherein the composition comprises one or more of the proteins which interact with Dkk, including Dkk-1, such as those depicted in FIG. 5, or a Dkk-binding fragment thereof, or an antisense, siRNA, or shRNA molecule which recognizes and binds to a nucleic acid encoding one or more Dkk interacting or Dkk-1 interacting proteins. The invention further provides such a method wherein the composition comprises an LRP5/LRP6/Zmax1 antibody, Dkk antibody, a Dkk-1 antibody or an antibody to a Dkk-1 interacting protein. The invention further provides such a method wherein the compositions comprise an aptamer of Dkk or Dkk-1, such as those depicted in FIG. 3 (SEQ ID NOs:171-188), or a mimetic of such an aptamer. The method further provides that invention further provides such a method wherein the compositions comprise an aptamer of a Dkk interacting or Dkk-1 interacting protein, or a mimetic of such an aptamer.

A composition of the present invention may modulate activity either by enhancing or inhibiting the binding of Dkk to LRP5/LRP6/Zmax1, particularly Dkk-1, or the binding of Dkk-1 to a Dkk-1 interacting protein, such as those shown in FIG. 5. A composition of the present invention may comprise an LRP5 peptide aptamer, such as OST262 (SEQ ID NO:208), FIGS. 4 (SEQ ID NOs:189-192) (particularly, peptide (SEQ ID NO:191) and 13 (including SEQ ID NOs:204-214), or a mimetic of such an aptamer. Preferred compositions of the present invention also comprise LRP5 antibodies.

Another aspect of the invention is to provide for a method of regulating Dkk-Wnt pathway activity in a subject comprising administering a therapeutically effective amount of a composition which modulates Dkk-Wnt pathway activity. In a preferred embodiment, the Dkk protein is Dkk-1. In a particularly preferred embodiment, Dkk-1 activity is decreased. In another embodiment, Dkk activity modulates bone mass and/or lipid levels. In a preferred embodiment, bone mass is increased and/or lipid levels are decreased. In another preferred embodiment, the modulation in bone mass is an increase in bone strength determined via one or more of a decrease in fracture rate, an increase in areal bone density, an increase in volumetric mineral bone density, an increase in trabecular connectivity, an increase in trabecular density, an increase in cortical density or thickness, an increase in bone diameter, and an increase in inorganic bone content. In another preferred embodiment, the Wnt is Wnt1-Wnt19. In a particularly preferred embodiment, the Wnt is Wnt1, Wn3, Wnt3a, or Wnt10b. Preferred compositions comprise Dkk-modulating or Dkk-1-modulating compounds or one or more Dkk interacting or Dkk-1 interacting proteins, or a Dkk-binding fragment thereof. Other preferred Dkk modulating compositions comprise a Dkk or Dkk-1 antibody or an antibody to a Dkk interacting or Dkk-1 interacting protein. Also contemplated are antisense, siRNA, and shRNA molecules which recognize and bind to a nucleic acid encoding one or more Dkk-1 interacting proteins. The invention further provides such a method wherein the composition comprises a biologically active or LRP5/LRP6/HBM binding fragment of Dkk, including Dkk-1, such as those depicted in FIG. 6 or a mimetic of those fragments depicted in FIG. 6. The Dkk modulating composition may also comprise a peptide aptamer of a Dkk interacting or Dkk-1 interacting protein, or a mimetic of such an aptamer. A composition of the present invention may modulate activity either by enhancing or inhibiting the binding of Dkk, including Dkk-1, to LRP5, LRP6, or HBM or the binding of Dkk, including Dkk-1, to a Dkk interacting protein, such as those shown in FIG. 5. The invention further provides such a method wherein the composition comprises an aptamer of Dkk or Dkk-1, such as those depicted. A composition of the present invention may comprise an LRP5 peptide aptamer, such as OST262 (SEQ ID NO:208). Preferred compositions of the present invention also comprise LRP5 antibodies.

A further aspect of the invention is to provide for a method of modulating Wnt signaling in a subject comprising administering a therapeutically effective amount of a composition which modulates Dkk activity or modulates Dkk interaction with LRP5 (or LRP6 or HBM). In a preferred embodiment, the Dkk protein is Dkk-1. In a particularly preferred embodiment, Dkk-1 activity is decreased. In another embodiment, Dkk activity modulates bone mass and/or lipid levels. In a preferred embodiment, bone mass is increased and/or lipid levels are decreased. In another preferred embodiment, the modulation in bone mass is an increase in bone strength determined via one or more of a decrease in fracture rate, an increase in areal bone density, an increase in volumetric mineral bone density, an increase in trabecular connectivity, an increase in trabecular density, an increase in cortical density or thickness, an increase in bone diameter, and an increase in inorganic bone content. In another preferred embodiment, the Wnt is Wnt1 Wnt19. In a particularly preferred embodiment, the Wnt is Wnt1, Wnt3, Wnt3a, or Wnt10b. Preferred Wnt modulating compositions comprise one or more Dkk interacting or Dkk-1 interacting proteins, or a biologically active or LRP5/LRP6/HBM binding fragment thereof. Also contemplated are antisense, siRNA, and shRNA molecules which recognize and bind to a nucleic acid encoding one or more Dkk interacting or Dkk-1 interacting proteins. The invention further provides such a method wherein the composition comprises a biologically active or LRP5/LRP6/HBM binding fragment of Dkk or Dkk-1, such as those depicted in FIG. 6 or a mimetic of those fragments depicted in FIG. 6. The Dkk modulating composition may also comprise a peptide aptamer of a Dkk interacting or Dkk-1 interacting protein, or a mimetic of such an aptamer A composition of the present invention may modulate activity either by enhancing or blocking the binding of Dkk, including Dkk-1, to LRP5, LRP6, or HBM or the binding of Dkk or Dkk-1 to a Dkk interacting or Dkk-1 interacting protein, such as those shown in FIG. 5. The invention further provides such a method wherein compositions comprising an aptamer of Dkk or Dkk-1, such as those depicted in FIG. 3 (SEQ ID NOs:171-188), or a mimetic of such an aptamer. The invention further provides such a method wherein the composition comprises a Dkk or Dkk-1 antibody or an antibody to a Dkk interacting or Dkk-1 interacting protein. The invention further provides such a method wherein compositions of an LRP5 peptide aptamer, such as OST262 (SEQ ID NO:208), FIGS. 4 (SEQ ID NO:189-192 (particularly peptide (SEQ ID NO:191) and FIG. 13 (including SEQ ID NOs:204-214), or a mimetic of such an aptamer. Additional preferred compositions of the present invention also comprise LRP5 antibodies.

Additionally, the invention provides for a method of modulating bone mass and/or lipid levels in a subject comprising administering to the subject a composition which modulates Dkk activity or Dkk interaction with LRP5 in an amount effective to modulate bone mass and/or lipid levels, wherein bone mass and/or lipid levels are in need of modulation. In a preferred embodiment, the Dkk protein is Dkk-1. In a particularly preferred embodiment, Dkk-1 activity is decreased. In another embodiment, Dkk activity modulates bone mass and/or lipid levels. In a preferred embodiment, bone mass is increased and/or lipid levels are decreased. In another preferred embodiment, the modulation in bone mass is an increase in bone strength determined via one or more of a decrease in fracture rate, an increase in areal bone density, an increase in volumetric mineral bone density, an increase in trabecular connectivity, an increase in trabecular density, an increase in cortical density or thickness, an increase in bone diameter, and an increase in inorganic bone content. Preferred bone mass and/or lipid modulating compositions comprise one or more Dkk interacting or Dkk-1 interacting proteins, or a biologically active or LRP5/LRP6/HBM binding fragment thereof. Also contemplated are antisense, siRNA, and shRNA molecules which recognize and bind to a nucleic acid encoding one or more Dkk interacting or Dkk-1 interacting proteins. The invention further provides such a method wherein the composition comprises a biologically active or LRP5/LRP6/HBM binding fragment of Dkk, including Dkk-1, such as those depicted in FIG. 6 or a mimetic of those fragments depicted in FIG. 6. The Dkk modulating composition may also comprise a peptide aptamer of a Dkk interacting or Dkk-1 interacting protein, or a mimetic of such an aptamer. The invention further provides such a method wherein the composition comprises an aptamer of Dkk or Dkk-1, such as those depicted in FIG. 3 (SEQ ID NOs:171-188), or a mimetic of such an aptamer. A composition of the present invention may modulate activity either by enhancing or inhibiting the binding of Dkk, including Dkk-1, to LRP5, LRP6, or HBM or the binding of Dkk, including Dkk-1, to a Dkk interacting protein, such as those shown in FIG. 5. The invention further provides such a method wherein the composition comprises a Dkk or Dkk-1 antibody or an antibody to a Dkk interacting or Dkk-1 interacting protein. A composition of the present invention may comprise an LRP5 peptide aptamer, such as OST262 (SEQ ID NO:208), FIGS. 4 (SEQ ID NOs:189-192 (particularly peptide 13 (SEQ ID NO:191)) and 13 (including SEQ ID NOs:204-214), or a mimetic of such an aptamer. Preferred compositions of the present invention also comprise LRP5 antibodies. It is a further aspect of the invention that such lipid-modulated diseases include a cardiac condition, atherosclerosis, familial lipoprotein lipase deficiency, familial apoprotein CII deficiency, familial type 3 hyperlipoproteinemia, familial hypercholesterolemia, familial hypertriglyceridemia, multiple lipoprotein-type hyperlipidemia, elevated lipid levels due to dialysis and/or diabetes, and an elevated lipid level of unknown etiology.

Bone disorders contemplated for treatment and/or diagnosis by the methods and compositions disclosed herein include a bone development disorder, a bone fracture, age related loss of bone, a chondrodystrophy, a drug induced bone disorder, high bone turnover, hypercalcemia, hyperostosis, osteogenesis imperfecta, osteomalacia, osteomyelitis, osteoporosis, Paget's disease, osteoarthritis, and rickets.

It is a further object of the invention to provide a method of screening for compounds or compositions which modulates the interaction of Dkk with LRP5, LRP6, HBM, or a Dkk-binding fragment of LRP5, LRP6, or HBM comprising:
  (a) exposing Dkk or a LRP5/LRP6/HBM binding fragment thereof to a compound; and
  (b) determining whether said compound binds to Dkk or the LRP5/LRP6/HBM binding fragment thereof.

In a preferred embodiment, the Dkk is Dkk-1. In a particularly preferred embodiment, the binding of Dkk-1 to LRP5/LRP6/HBM is decreased.

It is a further object of the invention to provide a method of screening compounds or compositions which modulate the interaction of DKK with LRP5, LRP6, HBM, or a DKK-finding fragment thereof comprising:
  (a) exposing DKK or a LRP5/LRP6/HBM binding fragment thereof to a compound; and,
  (b) determining whether said compound modulates the interaction of Dkk with LRP5, LRP6, or HBM, or the Dkk-binding fragment of LRP5/LRP6/HBM.

In a preferred embodiment, the Dkk is Dkk-1. In a particularly preferred embodiment, the interaction of Dkk-1 with LRP5/LRP6/HBM is decreased.

It is a further object of the invention to provide a method of screening for compounds or compositions which modulates the interaction of Dkk with LRP5, LRP6, HBM, or a Dkk-binding fragment of LRP5, LRP6, or HBM comprising:
  (a) exposing Dkk or a LRP5/LRP6/HBM binding fragment thereof to a compound;
  (b) determining whether said compound binds to Dkk or the LRP5/LRP6/HBM binding fragment thereof; and,
  (c) further determining whether said compound modulates the interaction of Dkk with LRP5, LRP6, or HBM, or the binding fragment of LRP5/LRP6/HBM.

In preferred embodiments of such methods, Dkk or a biologically active fragment thereof is attached to a solid substrate. In an alternative embodiment of the invention, LRP5/LRP6/HBM, or a biologically active fragment thereof (such as the ligand binding domain), is exposed to the compound. Another aspect of the invention provides for compounds and compositions identified by the disclosed methods. A preferred embodiment of the invention provides that the compound screened in an afore-mentioned method is one or more proteins which interact with Dkk, particularly Dkk-1, as depicted in FIG. 5, or a LRP5/LRP6/HBM-binding fragment thereof. Another preferred embodiment provides that the compound comprises a Dkk or Dkk-1 peptide aptamer, such as those depicted in FIG. 3 (SEQ ID NOs:171-188), or a mimetic of such aptamers. The compound may also comprise a peptide aptamer of a Dkk interacting or Dkk-1 interacting protein, or a mimetic of such an aptamer. The method further provides that the compound comprises a Dkk or Dkk-1 antibody or an antibody to a Dkk-1 interacting protein. The invention further provides that the compound may comprise an LRP5 peptide aptamer, such as OST262 (SEQ ID NO:208), FIG. 4 (SEQ ID NOs:189-192) (particularly peptide 13 (SEQ ID NO:191)) and FIG. 13 (including SEQ ID NOs:204-214), or a mimetic of such an aptamer. Preferred compounds of the present invention also comprise LRP5 antibodies.

It is a further object of the invention to provide a method of screening for compounds or compositions which modulate the interaction of Dkk and a Dkk interacting protein comprising:
  (a) exposing a Dkk interacting proteins or a Dkk-binding fragment thereof to a compound; and,
  (b) determining whether said compound binds to a Dkk interacting proteins or the Dkk-binding fragment thereof.

In a preferred embodiment, the Dkk is Dkk-1.

It is a further object of the invention to provide a method of screening for compounds or compositions which modulate the interaction of Dkk and a Dkk, interacting protein comprising:
  (a) exposing Dkk interacting protein(s) or a Dkk-binding fragment thereof to a compounds; and,
  (b) determining whether said compound modulates the interaction of Dkk and Dkk interacting proteins.

It is a further object of the invention to provide a method of screening for compounds or compositions which modulate the interaction of Dkk and a Dkk interacting protein comprising:
  (a) exposing a Dkk interacting proteins or a Dkk-binding fragment thereof to a compound;
  (b) determining whether said compound binds to a Dkk interacting proteins or the Dkk-binding fragment thereof; and,
  (c) further determining whether said compound modulates the interaction of Dkk and Dkk interacting proteins.

In a preferred embodiment, Dkk is Dkk-1.

In preferred embodiments of such methods, the Dkk interacting proteins, particularly Dkk-1 interacting proteins, or a Dkk-binding fragment thereof are attached to a solid substrate. Another aspect of the invention provides for compounds and compositions identified by the disclosed methods. A preferred embodiment provides that the compound comprises a Dkk or Dkk-1 peptide aptamer, such as those depicted in FIG. 3 (SEQ ID NOs:171-188), or a mimetic of such aptamers. The compound may also comprise a peptide aptamer of a Dkk interacting or Dkk-1 interacting protein, or a mimetic of such an aptamer. The compound may also comprise an antibody to a Dkk interacting or Dkk-1 interacting protein.

It is another object of the invention to provide for a composition for treating bone mass disorders comprising a LRP5/LRP6/HBM modulating compound and a pharmaceutically acceptabledexcipient and/or carrier therefor. Preferred LPP5 (or LRP6 or HBM) modulating compounds include Dkk or Dkk-1 or a LRP5/LRP6/HBM binding fragment thereof. Also contemplated are compounds which comprise monoclonal or polyclonal antibodies or immunologically active fragments thereof which bind to Dkk, including Dkk-1, and a pharmaceutically acceptable excipient and/or carrier. Another preferred embodiment provides that the modulating compound comprises one or more Dkk interacting or Dkk-1 interacting proteins, or a biologically active fragment thereof. Also contemplated are compounds which comprise monoclonal or polyclonal antibodies or immunologically active fragments thereof which bind to Dkk interacting or Dkk-1 interacting proteins, or a biologically active fragment thereof, and a pharmaceutically acceptable excipient and/or carrier. Another preferred embodiment provides that the modulating compound comprises an antisense, siRNA, and shRNA molecule which recognizes and binds to a nucleic acid encoding a Dkk interacting or Dkk-1 interacting protein. Another preferred embodiment provides that the modulating compound comprises a Dkk or Dkk-1 peptide aptamer, a mimetic of a Dkk or Dkk-1 peptide aptamer, a peptide aptamer of a Dkk interacting or Dkk-1 interacting protein, or a mimetic of such an aptamer. Another embodiment provides that the compound comprises an LRP5 peptide aptamer, such as OST262 (SEQ ID NO:208), FIG. 4 (SEQ ID NOs:189-192) (particularly peptide) and FIG. 13 (including SEQ ID NOs:204-214), or a mimetic of such an aptamer. Preferred compounds of the present invention also comprise LRP5 antibodies.

It is a further object of the invention to provide a pharmaceutical composition for treating a Dkk-mediated disease or condition comprising a compound which modulates Dkk activity and a carrier therefor, including pharmaceutically acceptable excipients. Such compositions include those wherein the compound comprises an antisense, siRNA, and shRNA molecule or an antibody which binds to Dkk, including Dkk-1, and thereby prevents it from interacting with LRP5, LRP6, or HBM. Other such compositions include one or more of Dkk interacting or Dkk-1 interacting proteins, such as those depicted in FIG. 5, or a Dkk-binding fragment thereof, or a monoclonal or polyclonal antibody, or immunologically active fragment thereof, which binds to a Dkk interacting or Dkk-1 interacting protein or Dkk-binding fragment thereof. Other contemplated compositions include antisense, siRNA, and shRNA molecules which recognize and bind to a nucleic acid encoding a Dkk interacting or Dkk-1 interacting protein. Further contemplated compositions include Dkk and Dkk-1 peptide aptamers, such as those depicted in FIG. 3 (SEQ ID NOs;171-188), mimetics of such aptamers, a peptide aptamer of a Dkk interacting or Dkk-1 interacting protein, or a mimetic of such an aptamer. Other contemplated compositions comprise an LRP5 peptide aptamer, such as OST262 (SEQ ID NO:208), FIG. 4 (SEQ ID NOs:189-192) (particularly peptide 13 (SEQ ID NO:191)) and FIG. 13 (including SEQ ID NO:204-214), or a mimetic of such an aptamer. Other preferred compositions of the present invention comprise LRP5 antibodies.

A further object of the invention to provide for a method of modulating the expression of a nucleic acid encoding a Dkk interacting or Dkk-1 interacting protein in an organism, such as those shown in FIG. 5, comprising the step of administering to the organism an effective amount of composition which modulates the expression of a nucleic acid encoding a Dkk-1 interacting protein. In a preferred embodiment, said composition comprises an antisense, siRNA, or shRNA molecule which recognizes and binds to a nucleic acid encoding a Dkk interacting or Dkk-1 interacting protein.

One aspect of the invention provides for a method of modulating at least one activity of Dkk or a Dkk-1 interacting protein comprising administering an effective amount of a composition which modulates at least one activity of Dkk or a Dkk-1 interacting protein. The invention provides for a composition comprising a Dkk interacting or Dkk-1 interacting protein, such as those shown in FIG. 5, or a biologically active fragment thereof. Other agents contemplated for this method are antisense, siRNA, or shRNA molecules which recognize and bind to a nucleic acid encoding a Dkk interacting or Dkk-1 interacting protein. The method further provides that the composition comprises a Dkk or Dkk-1 antibody or an antibody to a Dkk interacting or Dkk-1 interacting protein. In another preferred embodiment, the composition comprises a Dkk or Dkk-1 peptide aptamer, a mimetic of a Dkk or Dkk-1 peptide aptamer, a peptide aptamer of a Dkk interacting or Dkk-1 interacting protein, or a mimetic of such an aptamer. The method provides that a composition of the present invention may comprise an LRP5 peptide aptamer, such as OST262 (SEQ ID NO:208), FIG. 4 (SEQ ID NO:189-192) (particularly peptide including (SEQ ID NO:191)) and Figure including (SEQ ID NOs:204-214), or a mimetic of such an aptamer. Preferred compositions of the present invention also comprise LRP5 antibodies. In a further preferred embodiment, the modulated Dkk activity is lipid modulation or bone mass modulation.

In all of the testing/screening embodiments of the present invention discussed below to obtain compounds or compositions which ultimately impact LRP5/LRP6/HBM signaling, one skilled in the art will recognize that HBM can be used as a control in the absence of a test sample or compound. Further, the effect of a test sample of compound on Wnt signaling through the interaction of Dkk with LRP5/LRP6/HBM does not necessarily require a direct measurement of an association or interaction of Dkk and LRP5/LRP6/HBM. Other positive phenotypes/activities established by the High Bone Mass phenotype or by using HBM as a control.

One aspect of the invention provides for a method of identifying binding partners for a Dkk protein comprising the steps of:

(a) exposing the Dkk protein(s) or a LRP5/LRP6 binding fragment thereof to a potential binding partner; and (b) determining if the potential binding partner binds to a Dkk protein or the LRP5/LRP6 binding fragment thereof.

In a preferred embodiment, the Dkk is Dkk-1.

Another aspect of the invention is to provide for a method of identifying a compound that effects Dkk-mediated activity comprising (a) providing a group of transgenic animals having (1) a regulatable one or more Dkk interacting protein genes, (2) a knock-out of one or more Dkk interacting protein genes, or (3) a knock-in of one or more Dkk interacting protein genes;

(b) providing a second group of control animals respectively for the group of transgenic animals in step (a); and (c) exposing the transgenic animal group and the control animal group to a potential Dkk-modulating compound which modulates bone mass or lipid levels; and (d) comparing the transgenic animal group and the control animal group and determining the effect of the compound on bone mass or lipid levels in the transgenic animals as compared to the control animals.

In a preferred embodiment, the Dkk is Dkk-1.

It is another aspect of the invention to provide for a method for determining whether a compound modulates a Dkk interacting protein, said method comprising the steps of:

(a) mixing the Dkk interacting protein or a Dkk-binding fragment thereof with the ligand binding domain of Dkk in the presence of said at least one compound;

(b) measuring the amount of said binding domain of Dkk bound to said Dkk interacting protein or the Dkk-binding fragment thereof as compared to a control without said at least one compound; and (c) determining whether the compound reduces the amount of said binding domain of Dkk binding to said Dkk interacting protein or Dkk-binding fragment thereof.

In a preferred embodiment, the Dkk is Dkk-1.

In a preferred embodiment, the binding domain is attached to a solid substrate. The invention further provides for compounds identified by this method. In a preferred embodiment, the invention provides that the Dkk interacting or Dkk-1 interacting protein is detected by antibodies. In another preferred embodiment, the solid substrate is a microarray. Another preferred embodiment provides that the ligand binding domain of Dkk and/or Dkk interacting protein is fused or conjugated to a peptide or protein. The invention also provides that the compounds include Dkk and Dkk-1 peptide aptamers, mimetics of Dkk and Dkk-1 peptide aptamers, Dkk and Dkk-1 interacting proteins peptide aptamers, or mimetics of such aptamers.

An aspect of the invention provides a composition comprising one or more polypeptide sequences of one or more Dkk-1 interacting proteins, or a biologically active fragment thereof, one or more Dkk proteins, or a biologically active fragment thereof, or LRP5/LRP6/HBM polypeptide sequences or a biologically active fragment thereof (for example, the ligand binding domain) and a pharmaceutically acceptable excipient and/or carrier. Another aspect of the invention provides that the composition comprises a Dkk or Dkk-1 antibody or an antibody to a Dkk interacting or Dkk-1 interacting protein and a pharmaceutically acceptable excipient. A composition of the present invention may comprise an LRP5 peptide aptamer, such as OST262 (SEQ ID NO:208), FIG. 4 (SEQ ID NOs:189-192) (particularly peptide (SEQ ID NO:191)) and FIG. 13 (including SEQ ID NOs:204-214), or a mimetic of such an aptamer. A composition of the present invention may comprise a Dkk peptide aptamer, for example as shown in FIG. 3 (SEQ ID NOs:171-188). Preferred compositions of the present invention also comprise LRP5 antibodies.

Another aspect of the invention is to provide an antibody or immunologically active antibody fragment which recognizes and binds to a Dkk-1 amino acid sequence selected from the group consisting of: Asn34-His266 (SEQ ID NO:110), Asn34-Cys245 (SEQ ID NO 111), Asn34-Lys182 (SEQ ID NO:112), Cys97-His266 (SEQ ID NO:113), Val139-His266 (SEQ ID NO:114), Gly183-His266 (SEQ ID NO:115), Cys97-Cys245 (SEQ ID NO:116), or Val139-Cys245 (SEQ ID NO:117) of human Dkk-1. Additional antibodies may bind to any of the sequences depicted in FIGS. 3 (SEQ ID NOs: 171-188) and FIG. 4 (SEQ ID NOs:189-192). Another aspect of the invention is to provide for polyclonal antibodies to one or more amino acid sequences: Peptide 1-GNKYQTID-NYQPYPC (SEQ ID NO:118), Peptide 2-LDGYSRRT-TLSSKMYHTKGQEG (SEQ ID NO:119), Peptide 3-RIQKDHHQASNSSRLHTCQRH (SEQ ID NO:120), Peptide. 4-RGEIEETITESFGND (SEQ ID NO:121), and Peptide 5-EIFQRCYCGEGLSCRIQKD (SEQ ID NO: 122).

It is a further object of the invention to provide a nucleic acid encoding a Dkk protein, e.g. Dkk-1, a Dkk interacting or Dkk-1 interacting protein aptamer, or an LRP5 aptamer comprising a nucleic acid encoding a scaffold protein in-frame with the activation domain of Gal4 or LexA that is in-frame with a nucleic acid which encodes for a Dkk or Dkk-1 or Dkk interacting or Dkk-1 interacting protein amino acid sequence. Preferably the scaffold protein is thioredoxin (trxA), Si nuclease from *Staphylococcus* or M13. Other preferable embodiments include Dkk-1 amino acid sequences selected from FIG. 6.

It is yet a further object of the invention to provide a composition comprising a polypeptide sequence of FIG. 3 (SEQ ID NOs:171-188), FIG. 4 (SEQ ID NO:189-192), or of Dkk-1 interacting proteins identified in FIG. 5 and a pharmaceutically acceptable excipient and/or carrier.

Another aspect of the invention includes a method of detecting the modulatory activity of a compound on the binding interaction of a first peptide and a second peptide of a peptide binding pair that bind through extracellular interaction in their natural environment, comprising:

(i) culturing at least one eukaryotic cell, wherein the eukaryotic cell comprises;

a) a nucleotide sequence encoding a first heterologous fusion protein comprising the first peptide or a segment thereof joined to a DNA binding domain of a transcriptional activation protein;

b) a nucleotide sequence encoding a second heterologous fusion protein comprising the second peptide or a segment thereof joined to a transcriptional activation domain of a transcriptional activation protein;

wherein binding of the first peptide or segment thereof and the second peptide or segment thereof reconstitutes a transcriptional activation protein; and c) a reporter element activated under positive transcriptional control of the reconstituted transcriptional activation protein, wherein expression of the reporter element produces a selected phenotype;

(ii) incubating a compound with the eukaryotic cell under conditions suitable to detect the selected phenotype; and (iii) detecting the ability of the compound to affect the binding interaction of the peptide binding pair by determining whether the compound affects the expression of the reporter element which produces the selected phenotype;

wherein (1) said first peptide is a Dkk peptide and said second peptide is a peptide selected from LRP5, HBM, LRP6, and the Dkk-binding portion of LRP5/LRP6/HBM or (2) said first peptide is a Dkk-interacting protein or the Dkk-binding fragment thereof, and said second peptide is a Dkk peptide.

In one embodiment, the eukaryotic cell is a yeast cell. In a preferred embodiment, the yeast cell is *Saccharomyces*. In a particularly preferred embodiment, the *Saccharomyces* cell is *Saccharomyces cerevisiae*. The invention further provides that the compound may comprise a Dkk interacting or Dkk-1 interacting protein, or a biologically active fragment thereof. In one embodiment, the Dkk interacting or Dkk-1 interacting protein, or a Dkk-binding fragment thereof, is added directly to the assay. In another embodiment, the Dkk interacting or Dkk-1 interacting protein, or a Dkk-binding fragment thereof, is recombinantly expressed by the eukaryotic cell in addition to the first and second peptides. In a preferred embodiment the compound comprises a Dkk or Dkk-1 aptamer, a mimetic of a Dkk or Dkk-1 peptide aptamer, a Dkk interacting or Dkk-1 interacting protein aptamer, or a mimetic of a Dkk-1 interacting protein aptamer. Other preferred embodiments provide that the compound comprises an LRP5 peptide aptamer, such as OST262 (SEQ ID NO:208), FIG. 4 (SEQ ID NOs:189-192) (particularly peptide 13 (SEQ ID NO:191) and FIG. 13 (including SEQ ID NOs:204-214), or a mimetic of such an aptamer. Alternatively, the present invention also provides that the compound may comprise LRP5 antibodies or Dkk antibodies. In another embodiment, the yeast cell further comprises at least one endogenous nucleotide sequence selected from the group consisting of a nucleotide sequence encoding the DNA binding domain of a transcriptional activation protein, a nucleotide sequence encoding the transcriptional activation domain of a transcriptional activation protein, and a nucleotide sequence encoding the reporter element, wherein at least one of the endogenous nucleotide sequences is inactivated by mutation or deletion. In another embodiment, the peptide binding pair comprises a ligand and a receptor to which the ligand binds. In one embodiment, the transcriptional activation protein is Gal4, Gcn4, Hap1, Adr1, Swi5, Ste12, Mcm1, Yap1, Ace1, Ppr1, Arg81, Lac9, Qa1F, VP16, or a mammalian nuclear receptor. In another embodiment, at least one of the heterologous fusion proteins is expressed from an autonomously-replicating plasmid. In one embodiment, the DNA binding domain comprises a heterologous DNA-binding domain of a transcriptional activation protein. In a preferred embodiment, the DNA binding protein is selected from the group consisting of a mammalian steroid receptor and bacterial LexA protein. In another embodiment, the reporter element is selected from the group consisting of lacZ, a polynucleotide encoding luciferase, a polynucleotide encoding green fluorescent protein (GFP), and a polynucleotide encoding chloramphenicol acetyltransferase. In a particularly preferred embodiment, the reporter element is lacZ.

The invention further provides for a rescue screen for detecting the activity of a compound for modulating the binding interaction of a first peptide and a second peptide of a peptide binding pair, comprising:
(i) culturing at least one yeast cell, wherein the yeast cell comprises;
  a) a nucleotide sequence encoding a first heterologous fusion protein comprising the first peptide or a segment thereof joined to a DNA binding domain of a transcriptional activation protein;
  b) a nucleotide sequence encoding a second heterologous fusion protein comprising the second peptide or a segment thereof joined to a transcriptional activation domain of a transcriptional activation protein;
  wherein binding of the first peptide or segment thereof and the second peptide or segment thereof reconstitutes a transcriptional activation protein; and
  c) a reporter element activated under positive transcriptional control of the reconstituted transcriptional activation protein, wherein expression of the reporter gene prevents exhibition of a selected phenotype;
(ii) incubating a compound with the yeast cell under conditions suitable to detect the selected phenotype; and
(iii) detecting the ability of the compound to affect the binding interaction of the peptide binding pair by determining whether the compound affects the expression of the reporter element which prevents exhibition of the selected phenotype,
wherein said first peptide is a Dkk peptide and said second peptide is a peptide selected from LRP5, HBM, LRP6 and a Dkk-binding fragment of LRP5/LRP6/HBM.

In a preferred embodiment, the invention provides that the yeast cell is *Saccharomyces*. In a particularly preferred embodiment, the *Saccharomyces* cell is *Saccharomyces cerevisiae*. In one embodiment, the compound comprises one or more Dkk-interacting or Dkk-1 interacting proteins, or a Dkk-binding fragment thereof. Compounds used in the present invention may comprise an LRP5 peptide aptamer, such as OST262 (SEQ ID NO:208), FIG. 4 (SEQ ID NOs: 189-192) (particularly peptide 13 (SEQ ID NO:191)) and FIG. 13 (including SEQ ID NOs:204-214), or a mimetic of such an aptamer. Alternatively, the compound may comprise LRP5 antibodies or Dkk antibodies. In another embodiment, the yeast cell further comprises at least one endogenous nucleotide sequence selected from the group consisting of a nucleotide sequence encoding the DNA binding domain of a transcriptional activation protein, a nucleotide sequence encoding the transcriptional activation domain of a transcriptional activation protein, and a nucleotide sequence encoding the reporter gene, wherein at least one of the endogenous nucleotide sequences is inactivated by mutation or deletion. In another embodiment, the transcriptional activation protein is Gal4, Gcn4, Hap1, Adr1, Swi5, Ste12, Mcm1, Yap1, Ace1, Ppr1, Arg81, Lac9, Qa1F, VP16, or a mammalian nuclear receptor. In one embodiment, at least one of the heterologous fusion proteins is expressed from an autonomously-replicating plasmid. In another embodiment, the DNA binding domain is a heterologous DNA-binding domain of a transcriptional activation protein.

The invention also provides for a rescue screen for detecting the modulatory activity of a compound on the binding interaction of a first peptide and a second peptide of a peptide binding pair, comprising:
(i) culturing at least one yeast cell, wherein the yeast cell comprises;
  a) a nucleotide sequence encoding a first heterologous fusion protein comprising the first peptide or a segment thereof joined to a DNA binding domain of a transcriptional activation protein;
  b) a nucleotide sequence encoding a second heterologous fusion protein comprising the second peptide or a segment thereof joined to a transcriptional activation domain of a transcriptional activation protein;
  wherein binding of the first peptide or segment thereof and the second peptide or segment thereof reconstitutes a transcriptional activation protein; and
  c) a reporter element activated under positive transcriptional control of the reconstituted transcriptional activation protein, wherein expression of the reporter element prevents exhibition of a selected phenotype;
(ii) incubating a compound with the yeast cell under conditions suitable to detect the selected phenotype; and
(iii) detecting the ability of the compound to affect the binding interaction of the peptide binding pair by determining whether the compound affects the expression of the reporter element which prevents exhibition of the selected phenotype,
wherein said first peptide is a Dkk interacting or Dkk-1 interacting protein peptide and said second peptide is a Dkk or Dkk-1 peptide.

In a preferred embodiment of the rescue screen, the yeast cell is *Saccharomyces*. In a particularly preferred embodiment, the *Saccharomyces* cell is *Saccharomyces cerevisiae*. In another embodiment, the yeast cell further comprises at least one endogenous nucleotide sequence selected from the group consisting of a nucleotide sequence encoding the DNA binding domain of a transcriptional activation protein, a nucleotide sequence encoding the transcriptional activation domain of a transcriptional activation protein, and a nucleotide sequence encoding the reporter gene, wherein at least one of the endogenous nucleotide sequences is inactivated by mutation or deletion. In one embodiment, the transcriptional activation protein is Gal4, Gcn4, Hap1, Adr1, Swi5, Ste12, Mcm1, Yap1, Ace1, Ppr1, Arg81, Lac9, Qa1F, VP16, or a mammalian nuclear receptor. In another embodiment of the rescue screen, at least one of the heterologous fusion proteins is expressed from an autonomously-replicating plasmid. In another embodiment, the DNA binding domain is a heterologous DNA-binding domain of a transcriptional activation protein.

The invention also provides for a method for identifying potential compounds which modulate Dkk activity comprising:
  a) measuring the effect on binding of one or more Dkk interacting protein, or a Dkk-binding fragment thereof, with Dkk or a LRP5/LRP6/HBM binding fragment thereof in the presence and absence of a compound; and
  b) identifying as a potential Dkk modulatory compound a compound which modulates the binding between one or more Dkk interacting proteins or Dkk-binding fragment thereof and Dkk or LRP5/LRP6/HBM fragment thereof.

In a preferred embodiment, the Dkk is Dkk-1.

The invention further provides for any of the Dkk peptide aptamers of FIG. 3 (SEQ ID NOs:171-188). The invention also provides for any of the LRP peptide aptamers of FIG. 4 (SEQ ID NOs:189-192).

Another aspect of the invention provides for a method of identifying agents which modulate the interaction of Dkk with the Wnt signaling pathway comprising:
  (a) injecting mRNA encoding Dkk and an agent into a *Xenopus* blastomere;
  (b) assessing axis duplication or analyzing marker gene expression; and
  (c) identifying agents which elicit changes in axis duplication or marker gene expression as agents which modulate the interaction of Dkk with the Wnt signaling pathway. Wherein the agent may be chosen from among mRNA encoding Dkk interacting proteins, fragments thereof, siRNA, shRNA, antisense nucleotides, and antibodies. In a preferred embodiment, Dkk is Dkk-1. In a further embodiment, mRNA of HBM, LRP5/6, any Wnt (including Wnt1-Wnt19, particularly Wnt1, Wnt3, Wnt3a, and Wnt10b), Wrnt antagonist, or combination of these is co-injected into the *Xenopus* blastomere. In another embodiment, the marker gene analyzed could include Siamois, Xnr3, slug, Xbra, HNK-1, endodermin, Xlhbox8, BMP2, BMP4, XLRP6, EF-1, or ODC.

The present invention provides for a method for identifying agents which modulate the interaction of Dkk with the Wnt signaling pathway comprising:
  (a) transfecting cells with constructs encoding Dkk and potential Dkk interacting proteins, mRNA fragments thereof, siRNA, shRNA, or antisense, antibodies to LRP5/HBM/LRP6/Dkk/Dkk-interacting protein;
  (b) assessing changes in expression of a reporter gene linked to a Wnt-responsive promoter; and,
  (c) identifying as a Dkk interacting protein any protein which alters reporter gene expression compared with cells transfected with a Dkk construct alone. In a further preferred embodiment, the cells may be HOB-03-CE6, HEK293, or U2OS cells.

In alternative embodiments, the Wnt-responsive promoter is TCF or LEF. In other preferred embodiments, the cells are co-transfected with CMV beta-galactosidase or tk-Renilla.

The present invention further provides for a LRP5/HBM monoclonal or polyclonal antibody to one or more peptides of amino acid sequences MYWTDWVETPRIE (SEQ ID NO:123), MYWTDWGETPRIE (SEQ ID NO:124), KRTGGKRKEILSA (SEQ ID NO:125), ERVEKTTGDKRTRIQGR (SEQ ID NO:126), or KQQCDSFPDCIDGSDE (SEQ ID NO:127).

Additionally, the present invention provides a method for identifying compounds which modulate Dkk and LRP5/LRP6/HBM interactions comprising:
  (a) immobilizing LRP5/LRP6/HBM to a solid surface; and
  (b) treating the solid surface with a secreted Dkk protein or a secreted epitope-tagged Dkk and a test compound; and
  (c) determining whether the compound regulates binding between Dkk and LRP5/LRP6/HMB using antibodies to Dkk or the epitope tag or by directly measuring activity of an epitope tag.

In one embodiment, the Dkk is Dkk-1. In a preferred embodiment, the epitope tag is alkaline phosphatase, histidine, myc, or a V5 tag.

Another embodiment of the present invention provides for a method for identifying compounds which modulate Dkk and LRP5/LRP6/HBM interactions comprising:
  (a) creating an LRP5, LRP6, or HBM fluorescent fusion protein using a first fluorescent tag;
  (b) creating a Dkk fusion protein comprising a second fluorescent tag;
  (c) adding a test compound; and,
  (d) assessing changes in the ratio of fluorescent tag emissions using Fluorescence Resonance Energy Transfer (FRET) or Bioluminescent Resonance Energy Transfer (BRET) to determine whether the compound modulates Dkk and LRP5/LRP6/HBM interactions.

In a preferred embodiment, the Dkk is Dkk-1.

The present invention also provides for a method of diagnosing low or high bone mass and/or low or high lipid levels in a subject comprising examining expression of Dkk, LRP5, LRP6, HBM or HBM-like variant in the subject and determining whether Dkk, LRP5, LRP6, or HBM or a HBM-like variant is over or under-expressed to determine whether subject has (a) high or low bone mass and/or (b) high or low lipid levels.

The invention further provides for a transgenic animal wherein Dkk is knocked out in a tissue-specific fashion. In a preferred embodiment, the Dkk is Dkk-1. In one preferred embodiment, the tissue specificity is bone tissue. In another preferred embodiment, the tissue specificity is liver or other tissues or cells involved in regulating lipid metabolism or cancer tissue.

The present invention further provides a method of screening for compounds which modulate the interaction of Dkk with LRP5, LRP6, or HBM comprising:
  (a) exposing LRP5, LRP6, or HBM, or a Dkk-binding fragment of LRP5, LRP6, or HBM to a compound; and
  (b) determining whether said compound bound to LRP5, LRP6, or HBM or the Dkk-binding fragment of LRP5, LRP6, or HBM and further determining whether said compound modulates the interaction of Dkk and LRP5, LRP6, or HBM.

In one embodiment, the; Dkk is Dkk-1. In a preferred embodiment, the compound comprises an LRP5 peptide aptamer. Other preferred compositions include the peptide aptamer, OST262 (SEQ ID NO:208), FIG. 4 (SEQ ID NOs: 189-192) (particularly peptide 13 (SEQ ID NO:191) and FIG. 13 (including SEQ ID NOs:204-214), or a mimetic of such an aptamer, and an LRP5 antibody.

The present invention also provides a method for identifying compounds which modulate Dkk and LRP5/LRP6/HBM interactions comprising:

(a) immobilizing LRP5/LRP6/HBM to a solid surface; and
(b) treating the solid surface with a secreted Dkk protein or a secreted epitope-tagged Dkk and a test compound; and
(c) determining whether the compound regulates binding between Dkk and LRP5/LRP6/HBM using antibodies to Dkk or the epitope tag or by directly measuring activity of an epitope tag. In a preferred embodiment, the epitope tag is alkaline phosphatase, histidine, myc or a V5 tag.

In a preferred embodiment, the Dkk is Dkk-1.

The invention also provides for a method for identifying compounds which modulate the interaction of Dkk with the Wnt signaling pathway comprising:

(a) transfecting cells with constructs containing Dkk and Wnt proteins;
(b) assessing changes in expression of a reporter element linked to a Wnt-responsive promoter; and
(c) identifying as a Dkk/Wnt interaction modulating compound any compound which alters reporter gene expression compared with cells transfected with a Dkk construct alone.

In one embodiment, the Dkk is Dkk-1. In another embodiment, the Wnt is any of Wnt1-Wnt19. In a preferred embodiment, the Wnt is Wnt1, Wnt3, Wnt3a, or Wnt10b. In a particularly preferred embodiment the Wnt construct contains Wnt3a. In another particularly preferred embodiment, the Wnt construct contains Wnt1. In another preferred embodiment, the Wnt construct encodes for a Wnt that signals through the canonical Wnt pathway. In a particularly preferred embodiment, both Wnt3a and Wnt1 constructs are co-transfected into the cells. In another embodiment, the cells may be U2-OS, HOB-03-CE6, or HEK293 cells. In another embodiment, the reporter element used is TCF-luciferase, tk-Renilla, or a combination thereof.

The invention also provides for a method of testing compounds that modulate Dkk-mediated activity in a mammal comprising:

(a) providing a group of transgenic animals having (1) a regulatable one or more Dkk genes, (2) a knock-out of Dkk genes, or (3) a knock-in of one or more Dkk genes;
(b) providing a second group of control animals respectively for the group of transgenic animals in step (a); and
(c) exposing the transgenic animal group and control animal group to a potential Dkk-modulating compound which modulates bone mass or lipid levels; and
(d) comparing the transgenic animals and the control group of animals and determining the effect of the compound on bone mass or lipid levels in the transgenic animals as compared to the control animals.

In a preferred embodiment, the Dkk is Dkk-1.

The invention further provides variants of LRP5 which demonstrate HBM biological activity, i.e., that are "HBM-like." In preferred embodiments, variants G171F, M282V, G171K, G171Q, A65V, G171V, G171I, and A214V of LRP5 are provided. The invention further provides for the use any of these variants in the forgoing methods.

BRIEF DESCRIPTION OF THE FIGURES

FIG. 1 shows a schematic of the components of the Wnt signal transduction pathway. Schematic obtained from:

http://www.stanford.edu/~rnusse/pathWays/cell2.html

FIG. 2 (A-C) show bait sequences (SEQ ID NOs:168-170) utilized in yeast two hybrid (Y2H) screens for protein-protein interactions.

FIG. 3 shows a table of peptide aptamer insert sequences (SEQ ID NOs: 171-192) identified in Y2H screen with a Dkk-1 bait sequence.

FIG. 4 shows a table of peptide aptamer insert sequences identified in a Y2H screen using a LRP5 ligand binding domain bait sequence.

FIG. 5 shows a table of proteins identified in a Y2H screen using a Dkk-1 bait sequence. These proteins are identified by both their nucleic acid and amino acid accession numbers.

Figure 6:
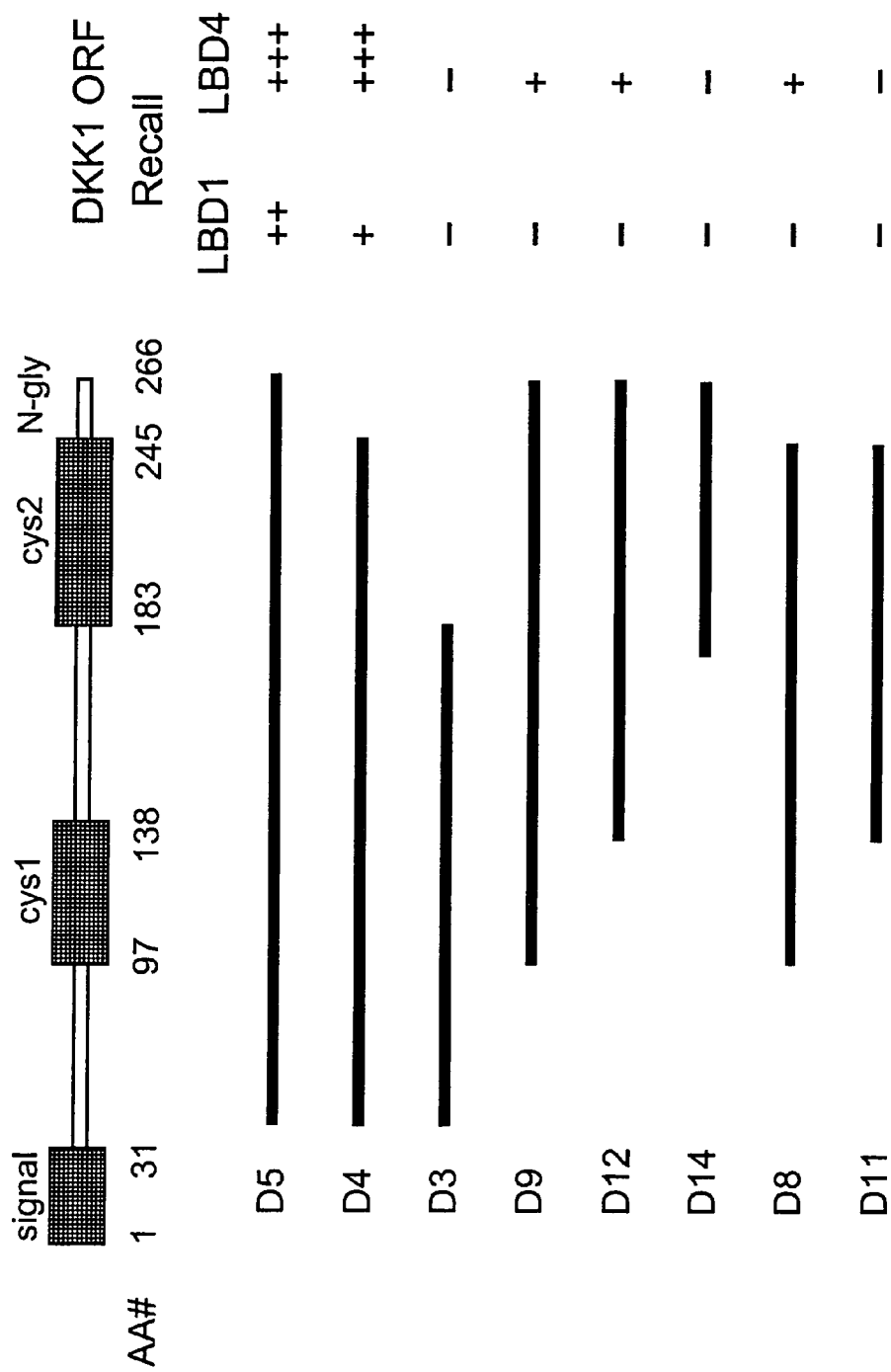

FIG. 6 shows the results of a minimum interaction domain mapping screen of Dkk-1 with LRP5. At the top, a map of Dkk-1 showing the location of the signal sequence, and cysteine rich domains 1 and 2. Below, the extent of domains examined using LRP5 LBD baits, LBD1 and LBD4, of FIG. 2. To the right, scoring of the binding results observed in the experiment.

Figure 7:
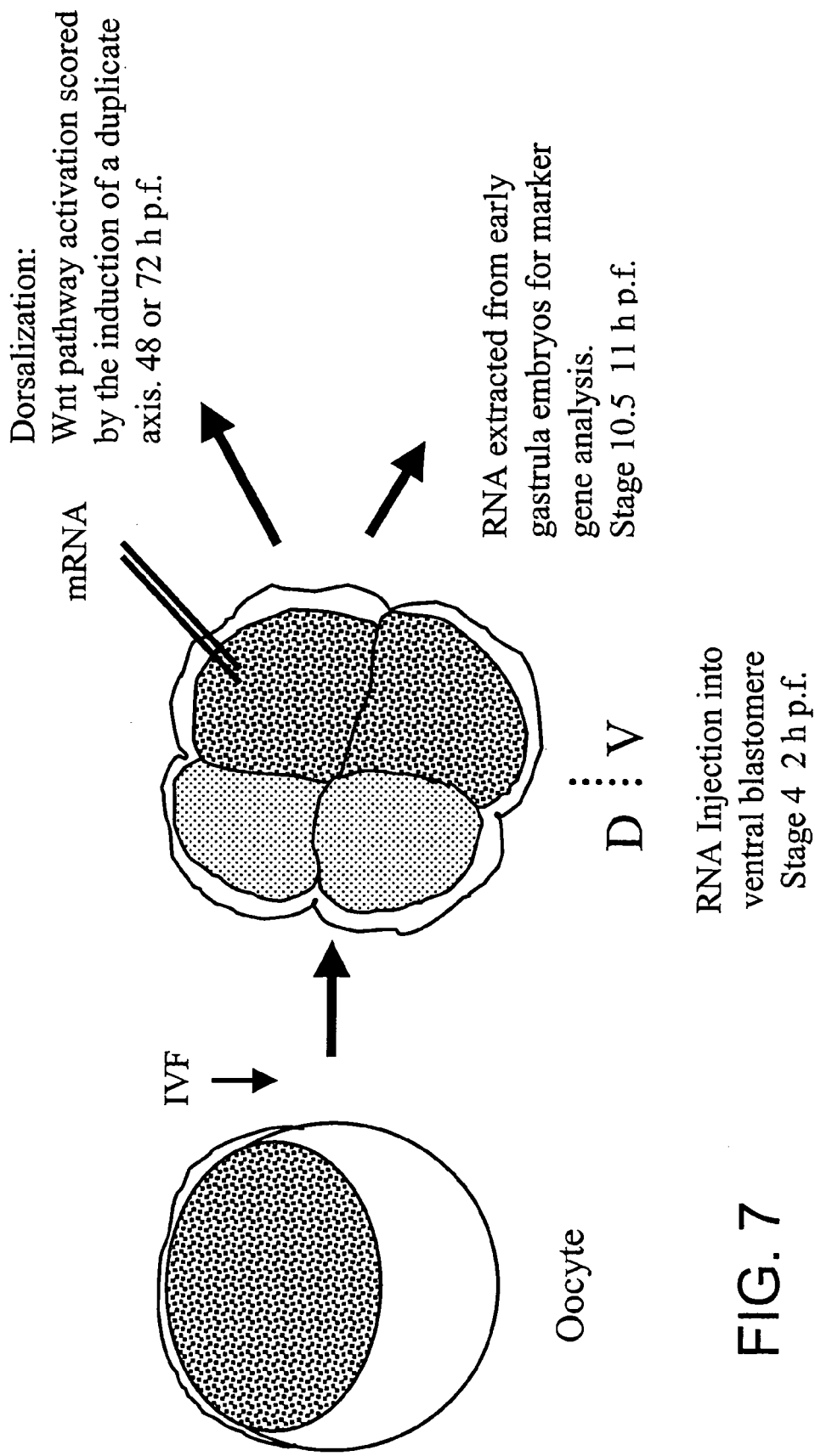

FIG. 7 shows a diagram of the *Xenopus* Embryo Assay for Wnt activity.

Figure 8:
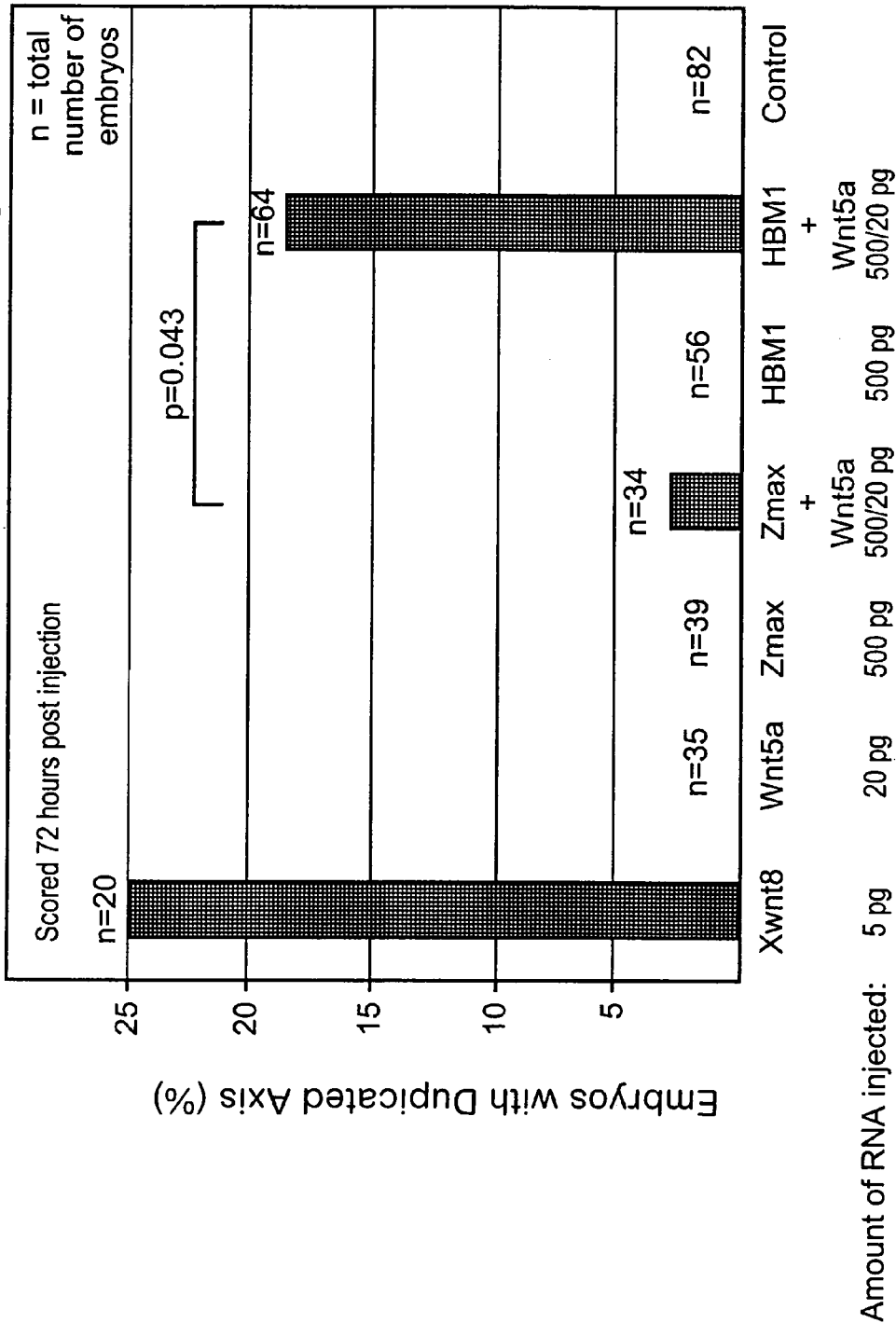

FIG. 8 shows the effects of Zmax/LRP5 and HBM on Wnt signaling in the *Xenopus* embryo assay.

Figure 9:
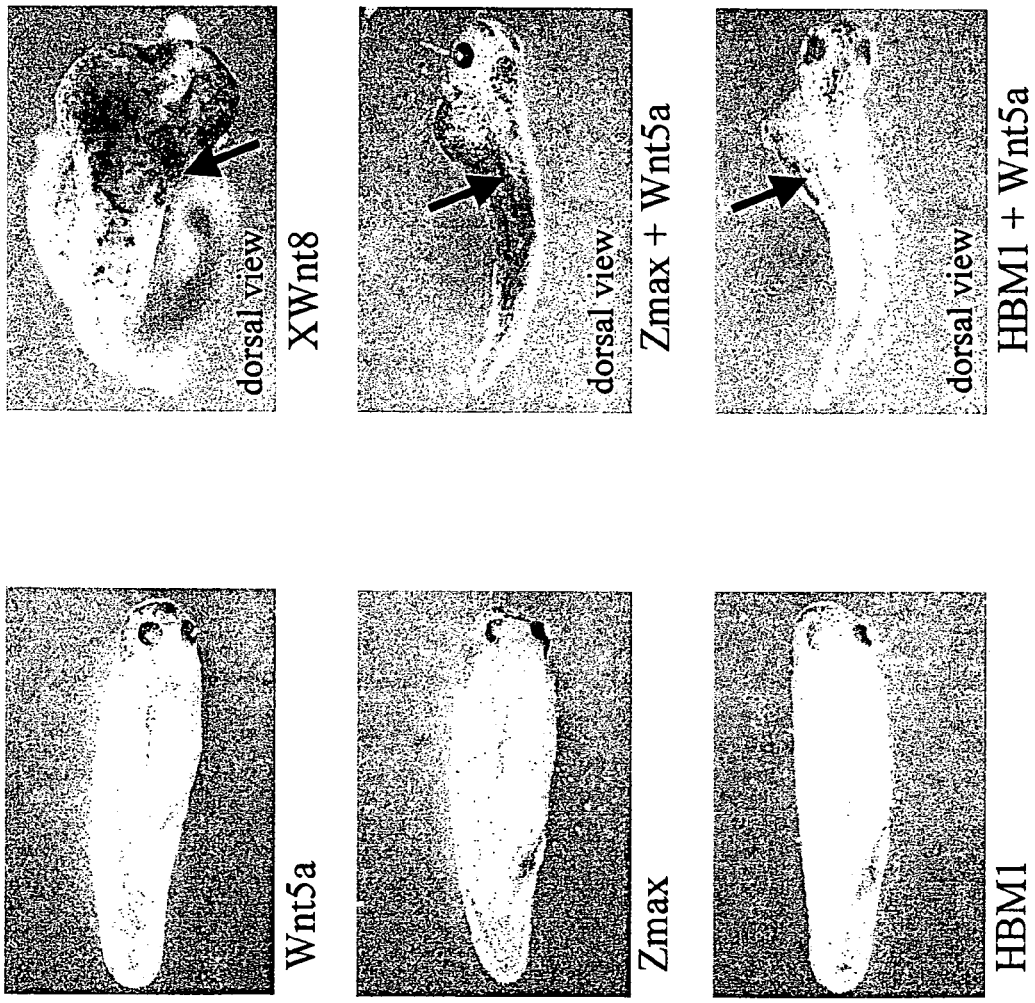

FIG. 9 shows the effects of Zmax/LRP5 and HBM on induction of secondary axis formation in the *Xenopus* embryo assay.

Figure 10:
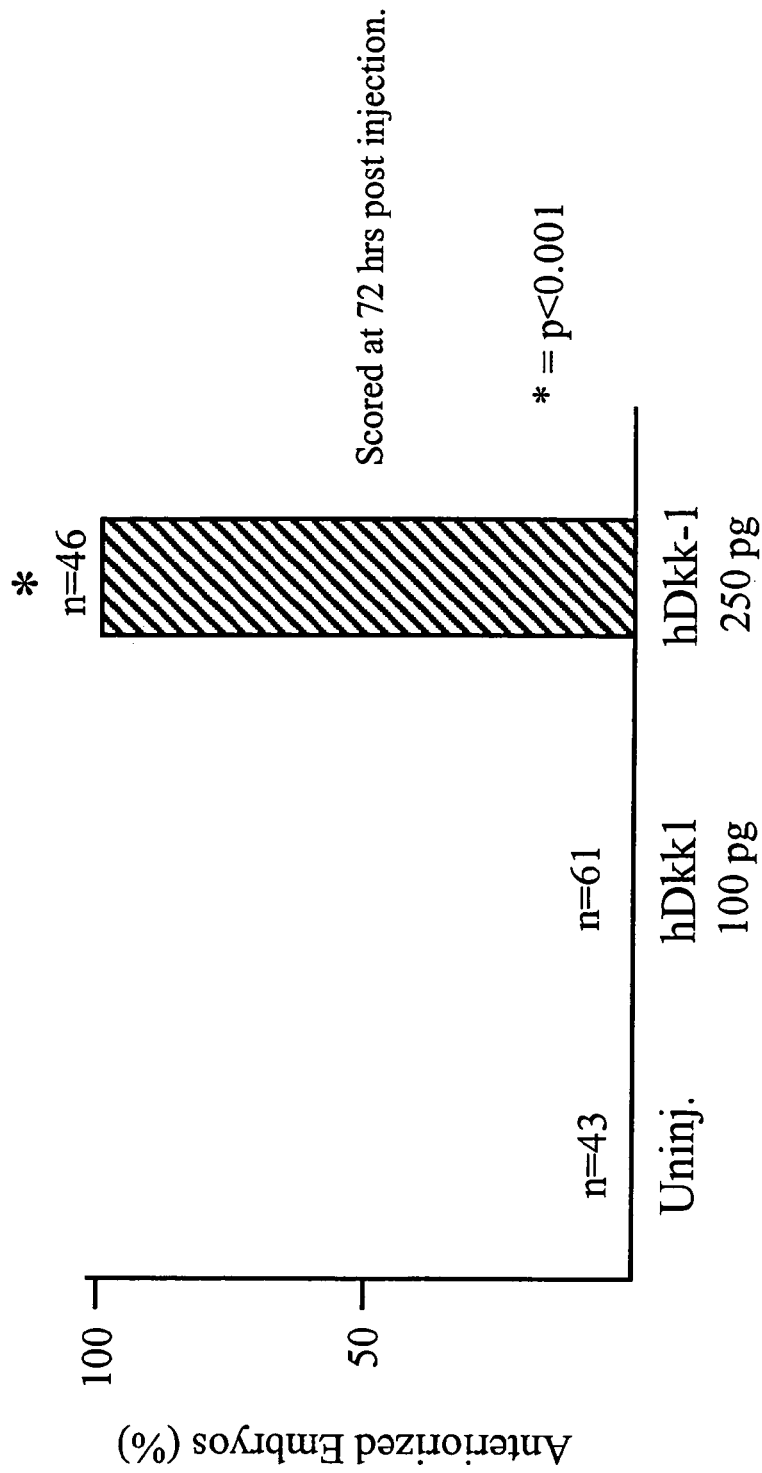

FIG. 10 shows the effects of human Dkk-1 on the repression of the canonical Wnt pathway.

FIG. 11 shows the effects of human Dkk-1 on Zmax/LRP5 and HBM-mediated Wnt signaling.

FIG. 12 shows pcDNA3.1 construct names with nucleotide sequences (including SEQ ID NOs:193-203) for LRP5-binding peptide aptamers, Dkk-1 peptides and control constructs.

FIG. 13 shows the amino acid sequences (including SEQ ID NOs:204-214) for the corresponding LRP5-binding peptides, Dkk-1 peptide aptamers and control constructs in FIG. 12.

Figure 14:
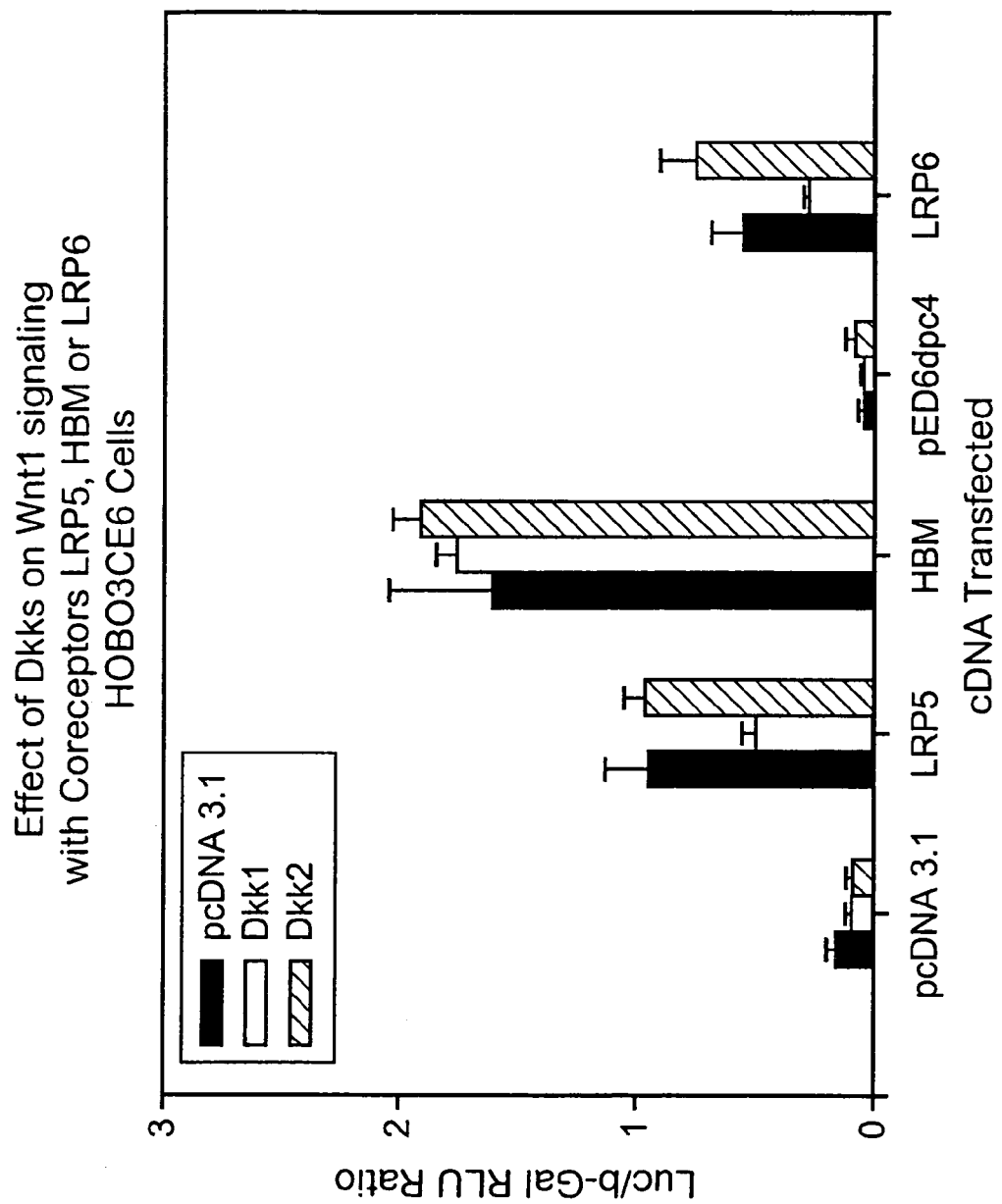

FIG. 14 shows the effects of Dkk-1 and Dkk-2 on Wnt1 signaling with coreceptors LRP5, HBM, and LRP6 in HOB03CE6 cells.

Figure 15:
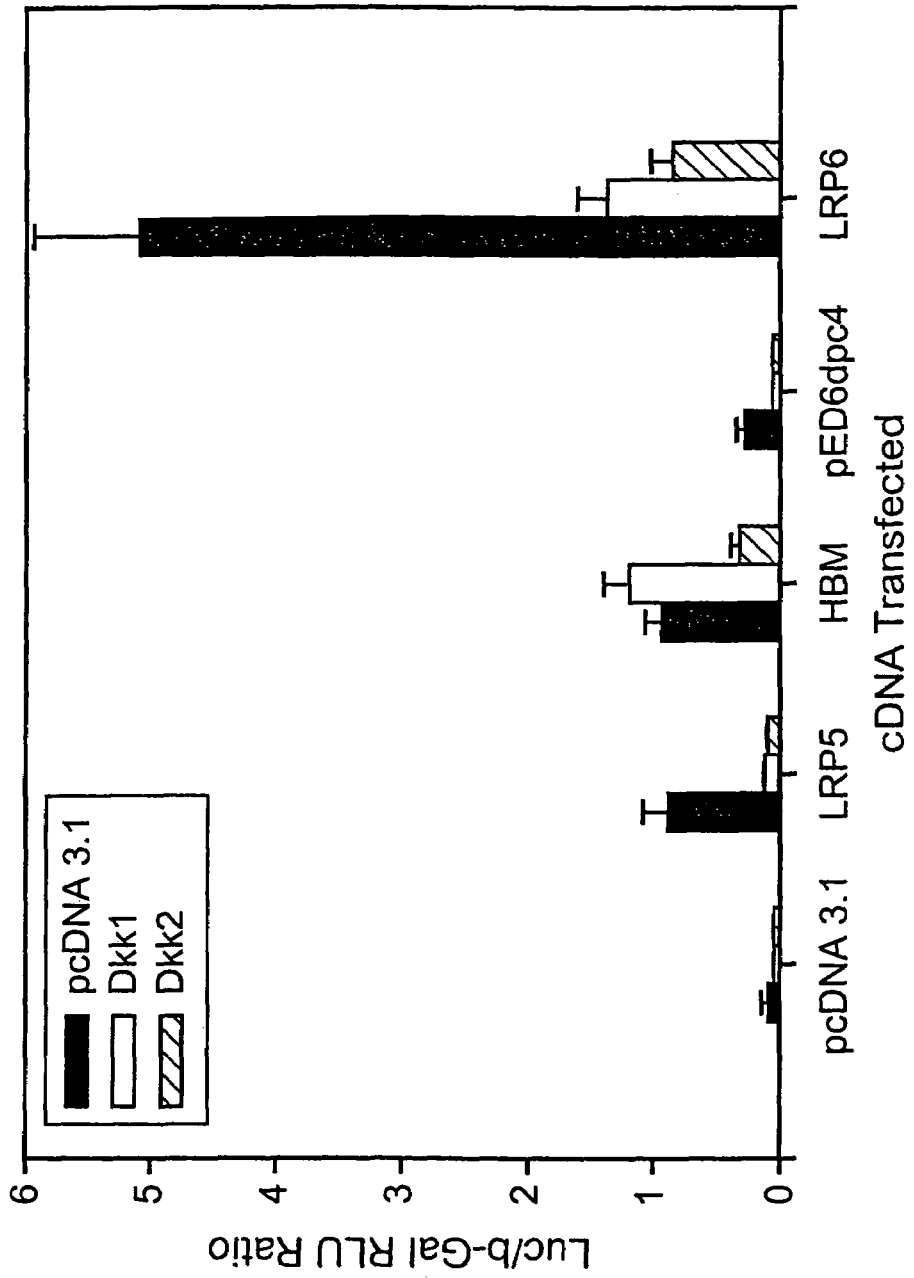

FIG. 15 shows the effects of Dkk-1 and Dkk-2 on Wnt3a signaling with coreceptors LRP5, HBM, and LRP6 in HOB03CE6 cells.

Figure 16:
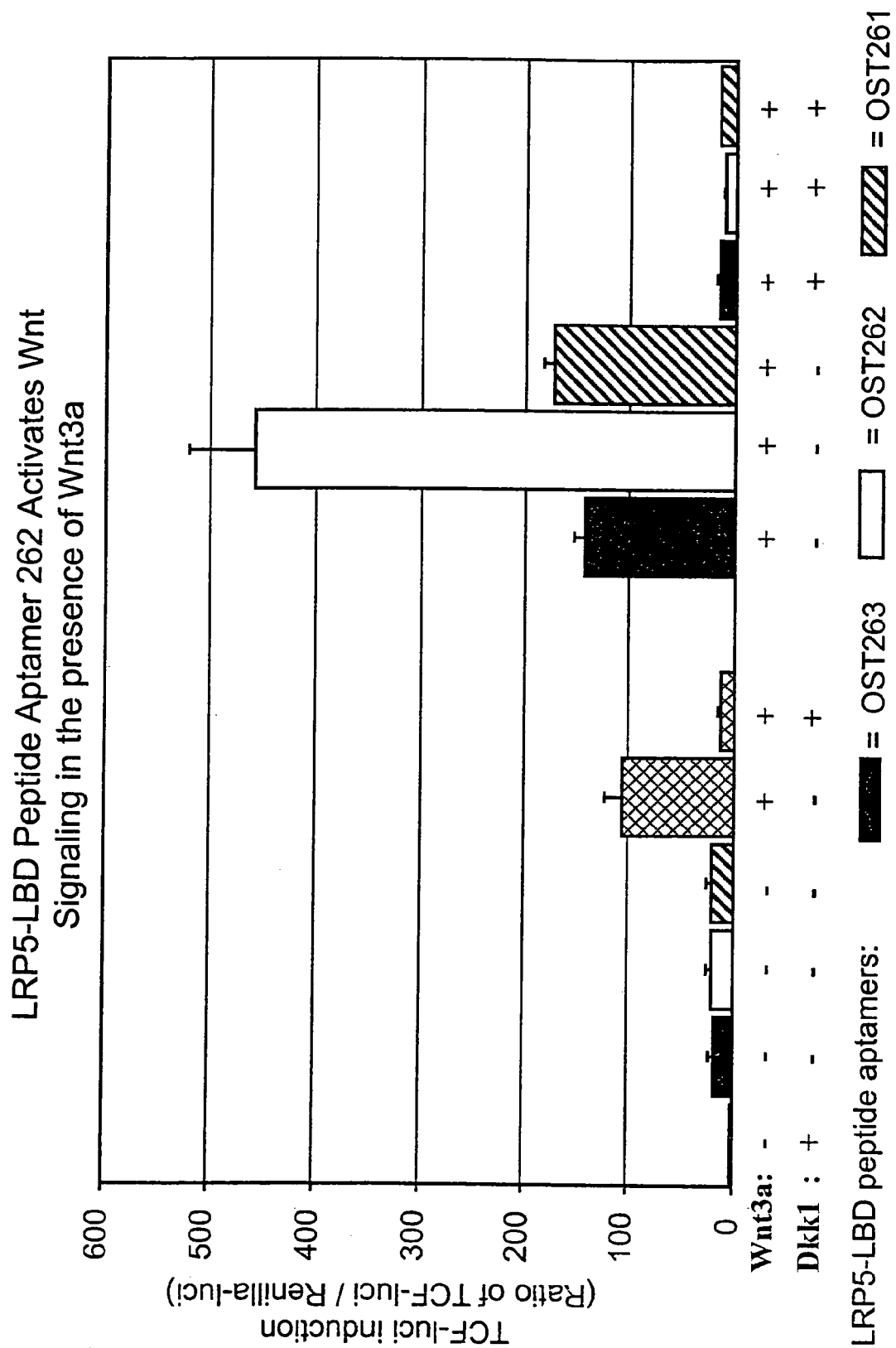

FIG. 16 demonstrates that the LRP5-LBD peptide aptamer 262 activates Wnt signaling in the presence of Wnt3a in U20S cells.

FIG. 17 shows the differential binding of an antibody generated to a sequence (a.a. 165-177) containing the HBM mutation in LRP5 in LRP5 and HBM virus-infected cells.

Figure 18:
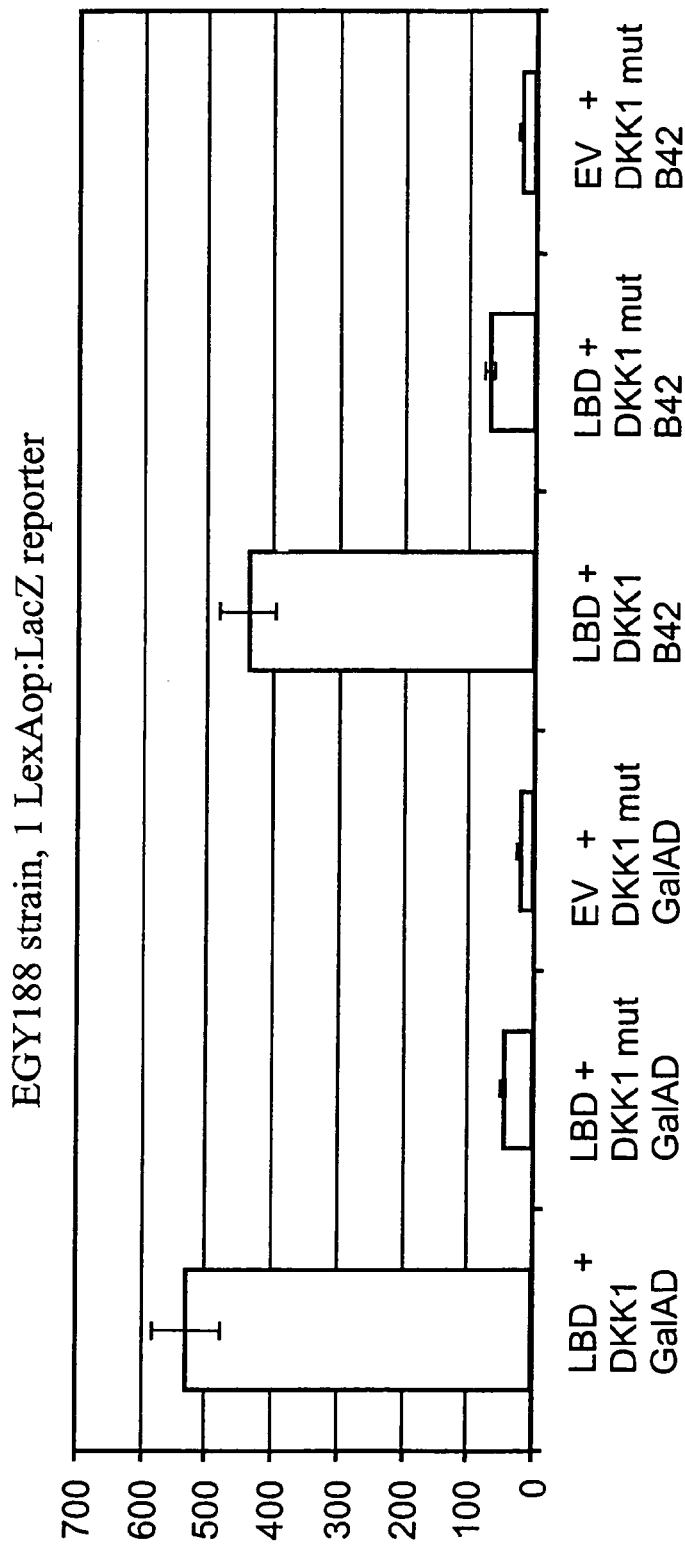

FIG. 18 shows data generated from a Y2H interaction trap where a mutant Dkk-1 (C220A) is unable to bind to LRP5 and demonstrating the window of capability of detecting small molecule effects on LRP and Dkk interactions.

Figure 19:
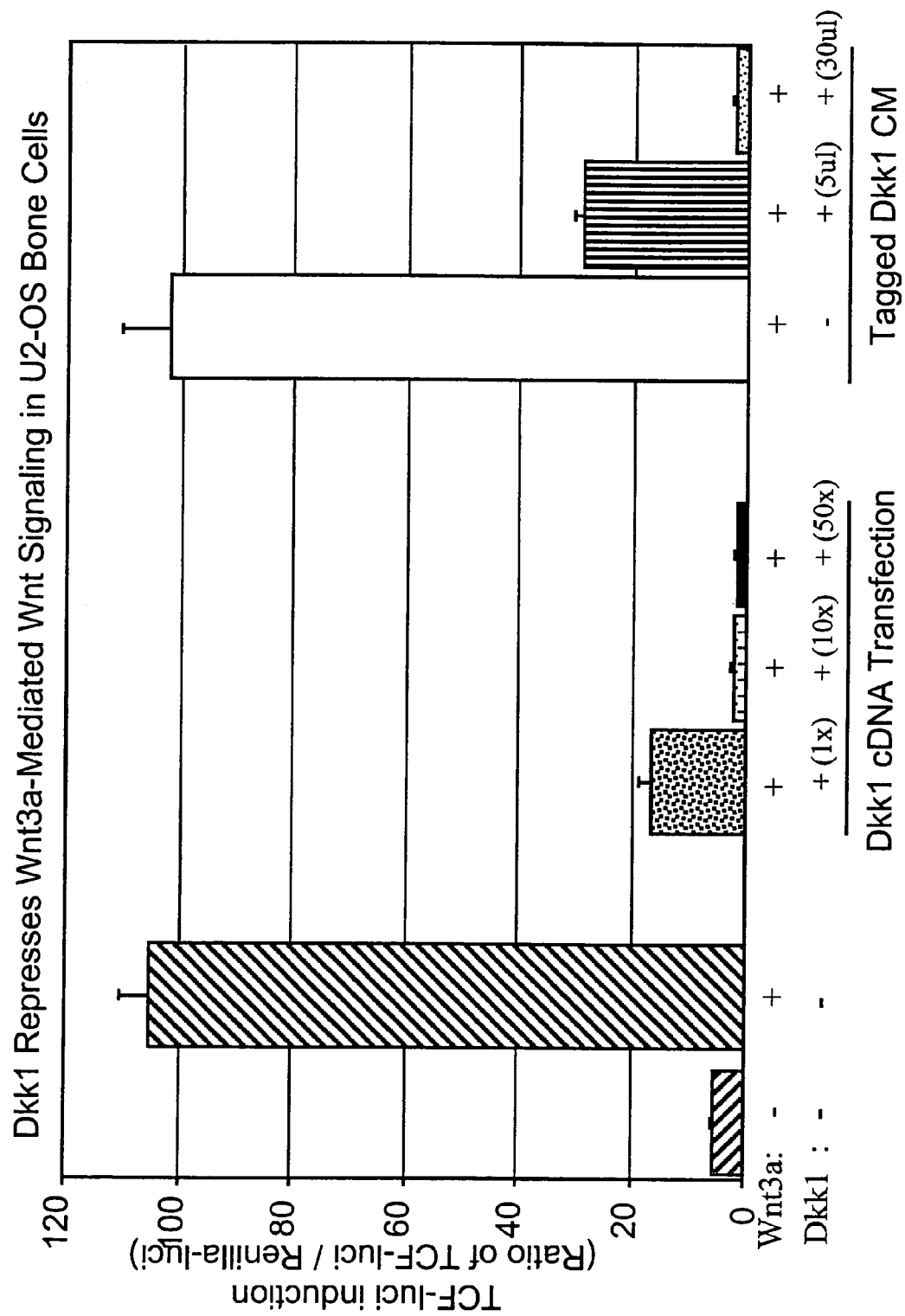

FIG. 19 shows that Dkk-1 represses Wnt3a-mediated Wnt signaling in U20S bone cells using the cell-based reporter gene assay for high throughput screening.

Figure 20:
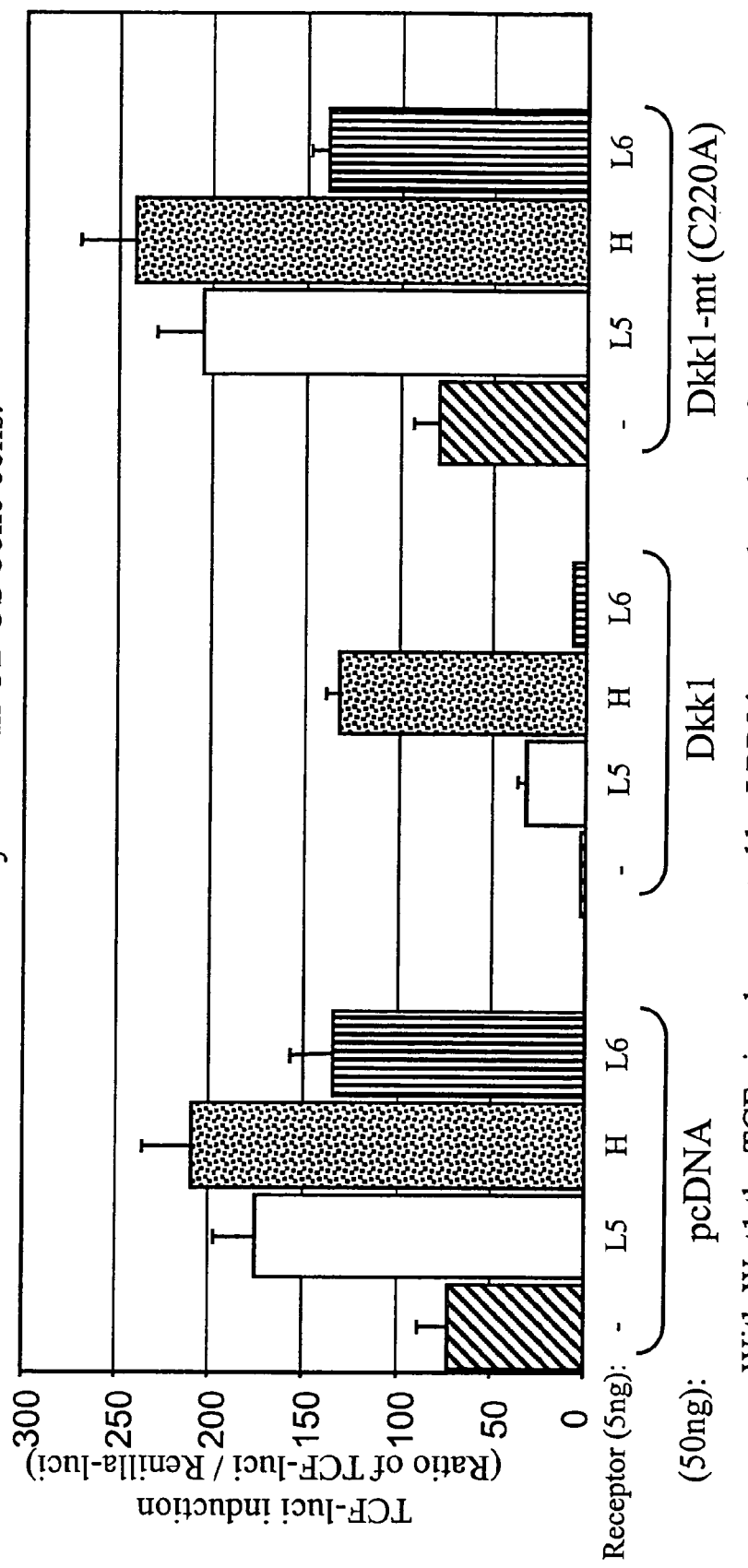

FIG. 20 demonstrates that Wnt1-HBM generated signaling is not efficiently inhibited by Dkk-1 in U20S bone cells while LRP5 and LRP6-mediated signaling are using the cell-based reporter gene assay for high throughput screening.

Figure 21:
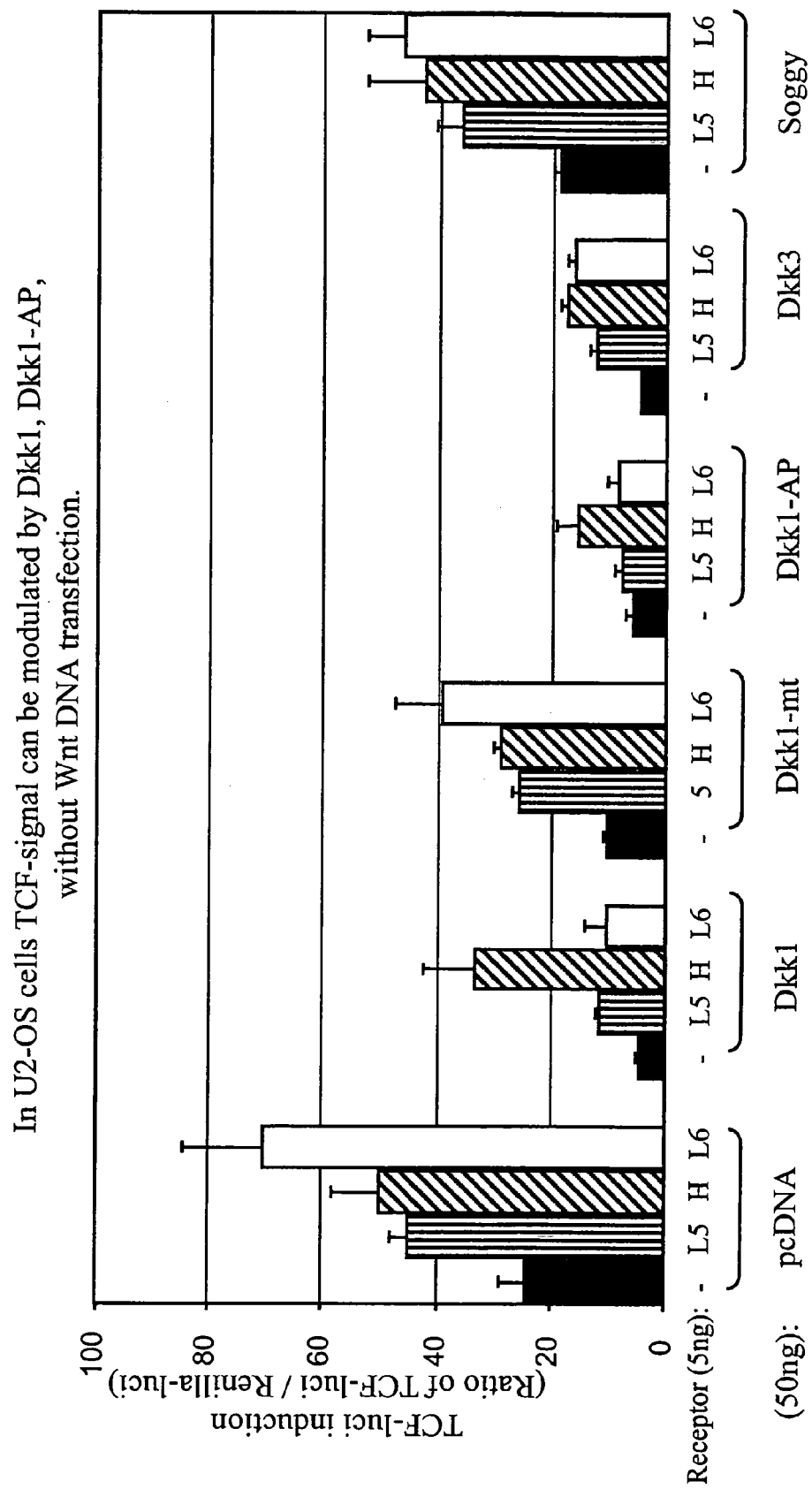

FIG. 21 shows that the TCF signal in the cell-based reporter gene assay for high throughput screening can be modulated by Dkk-1 and Dkk-1-AP without Wnt DNA transfection.

FIG. 22 shows the morphological results in the *Xenopus* assay using aptamers 261 and 262 from the LRP5-LBD to activate Wnt signaling.

Figure 23:

FIG. 23 demonstrates that LRP5-LBD aptamers 261 and 262 induce Wnt signaling over other LRP5 aptamers.

Figure 24:
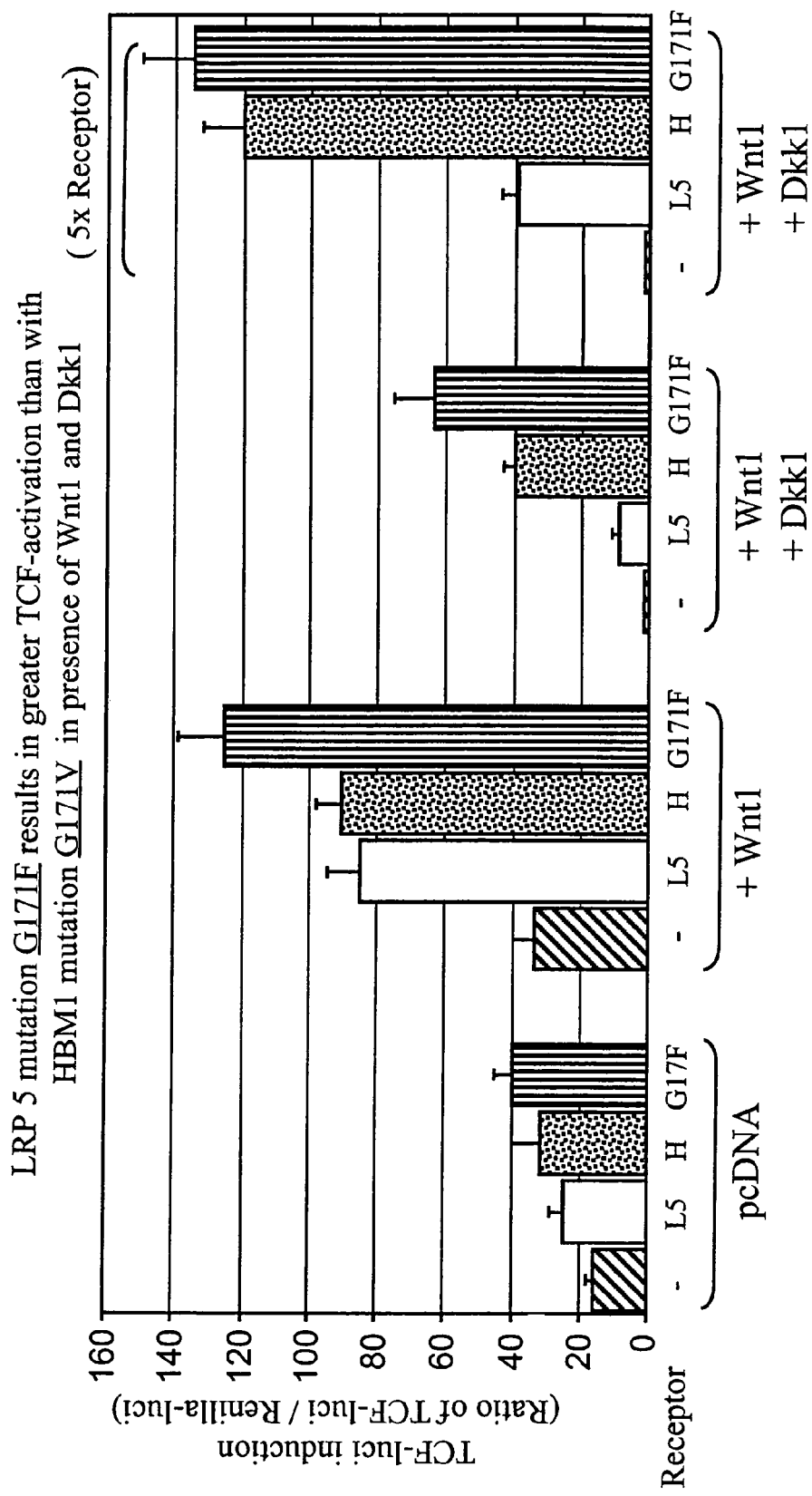

FIG. 24 shows that the mutation G171F in LRP5 produces a greater activation of the Wnt pathway than LRP5 which is consistent with HBM activity.

Figure 25:
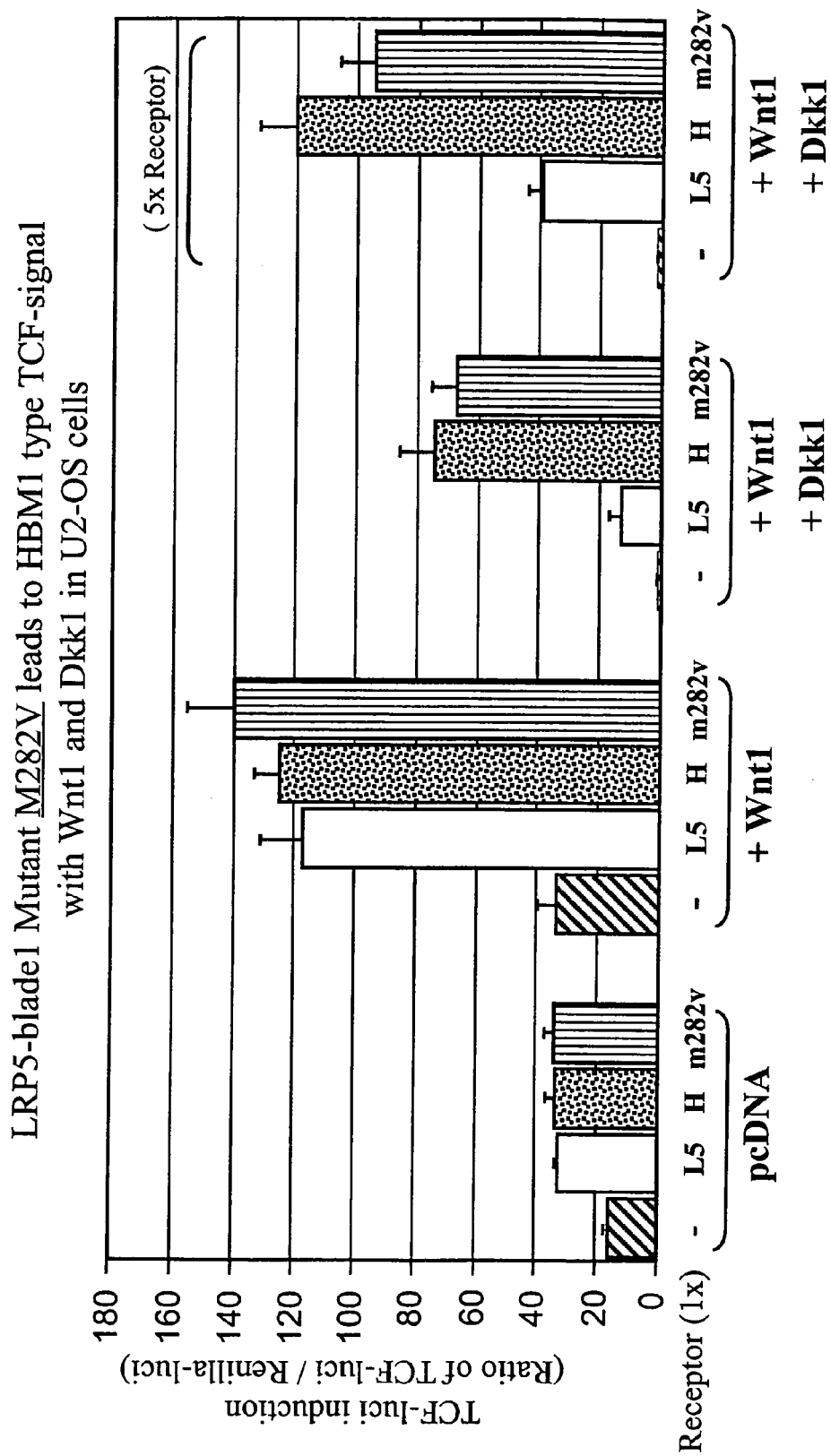

FIG. 25 shows that the mutation M282V in LRP5 produces an activation of the Wnt pathway which is consistent with HBM activity in U20$ cells.

Figure 26:
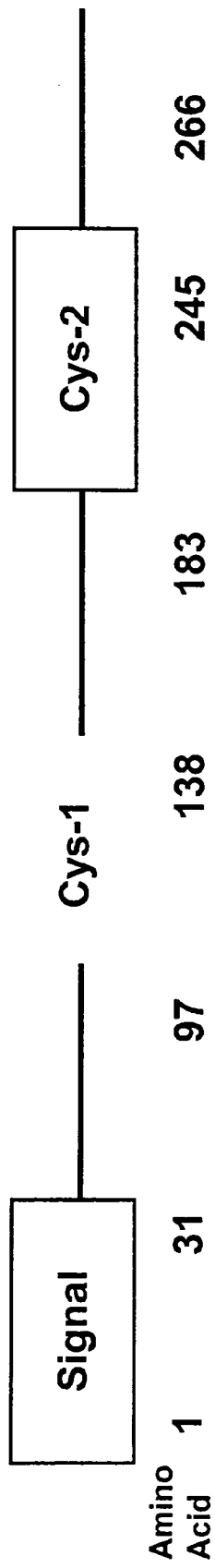

FIG. 26 shows the amino acid sequence of the various peptides of dkk-1 selected to generate polyclonal antibodies, their relationship to the Dkk-1 amino acid sequence and identities of polyclonal antibodies generated.

FIG. 27 shows a Western blot demonstrating that polyclonal antibody #5521 to amino acids 165-186 of Dkk-1 was able to detect Dkk1-V5 and Dkk1-AP from conditioned medium.

Figure 28B:
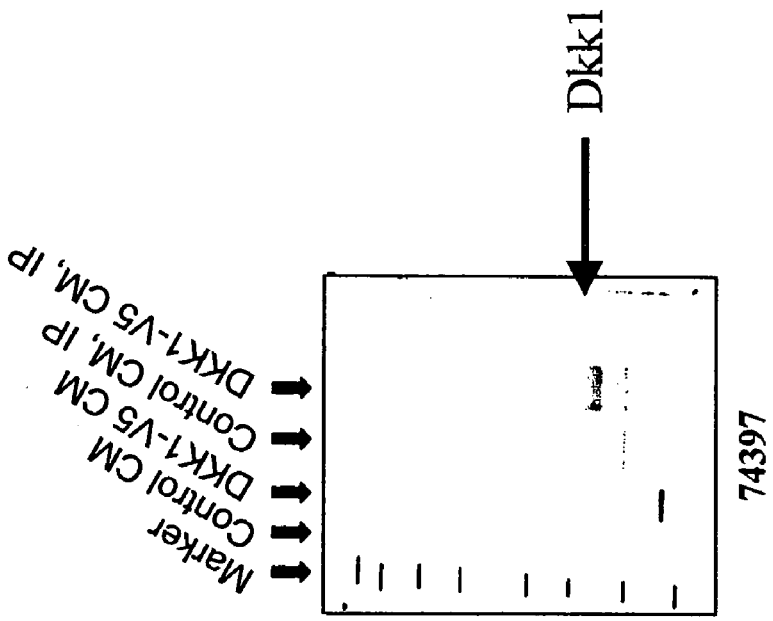
Figure 28A:
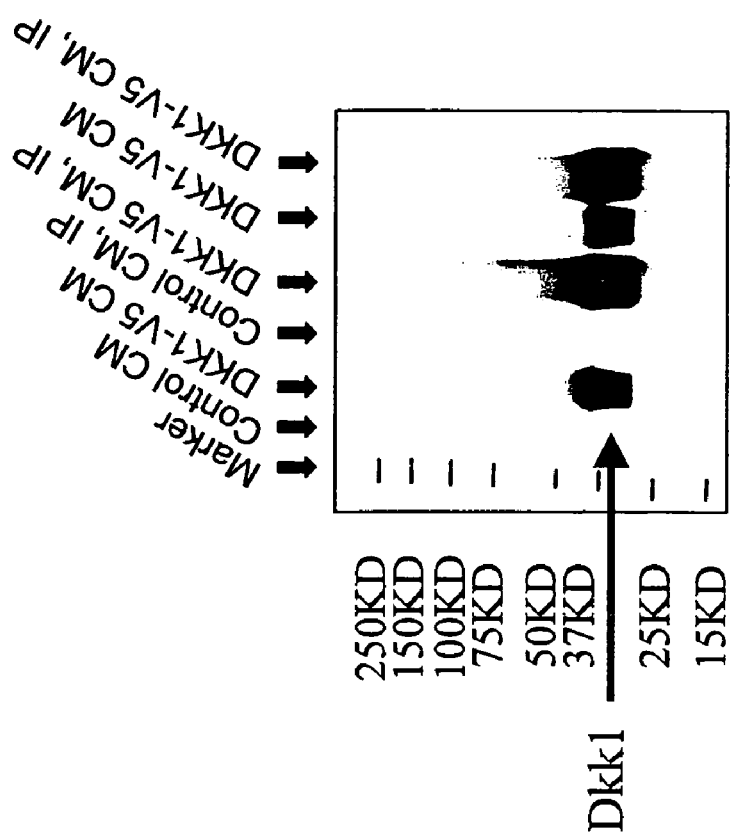

FIG. 28 shows a Western blot demonstrating that polyclonal antibody #74397 to amino acids 147-161 was able to detect Dkk1-V5 in both conditioned medium and immunoprecipitated conditioned medium.

DETAILED DESCRIPTION OF THE INVENTION

1. Definitions

In general, terms in the present application are used consistent with the manner in which those terms are understood in the art. To aid in the understanding of the specification and claims, the following definitions are provided.

"Gene" refers to a DNA sequence that encodes through its template or messenger RNA a sequence of amino acids characteristic of a specific peptide. The term "gene" includes intervening, non-coding regions, as well as regulatory regions, and can include 5' and 3' ends.

By "nucleic acid" is meant to include single stranded and double stranded nucleic acids including, but not limited to DNAs, RNAs (e.g., mRNA, tRNAs, siRNAs), cDNAs, recombinant DNA (rDNA), rRNAs, antisense nucleic acids, oligonucleotides, and oligomers, and polynucleotides. The term may also include hybrids such as triple stranded regions of RNA and/or DNA or double stranded RNA:DNA hybrids. The term also is contemplated to include modified nucleic acids such as, but not limited to biotinylated nucleic acids, tritylated nucleic acids, fluorophor labeled nucleic acids, inosine, and the like.

"Gene sequence" refers to a nucleic acid molecule, including DNA which contains a non-transcribed or non-translated sequence, which comprises a gene. The term is also intended to include any combination of gene(s), gene fragment(s), non-transcribed sequence(s) or non-translated sequence(s) which are present on the same DNA molecule.

The nucleic acid sequences of the present invention may be derived from a variety of sources including DNA, cDNA, synthetic DNA, synthetic RNA or combinations thereof. Such sequences may comprise genomic DNA which may or may not include naturally occurring introns. Moreover, such genomic DNA may be obtained in association with promoter regions and/or poly (A) sequences. The sequences, genomic DNA or cDNA may be obtained in any of several ways.

Genomic DNA can be extracted and purified from suitable cells by means well known in the art. Alternatively, mRNA can be isolated from a cell and used to produce cDNA by reverse transcription or other means.

"cDNA" refers to complementary or copy DNA produced from an RNA template by the action of RNA-dependent DNA polymerase (reverse transcriptase). Thus, a "cDNA clone" means a duplex DNA sequence for which one strand is complementary to an RNA molecule of interest, carried in a cloning vector or PCR amplified cDNA can also be single stranded after first strand synthesis by reverse transcriptase. In this form, it is a useful PCR template and does not need to be carried in a cloning vector. This term includes genes from which the intervening sequences have been removed. Thus, the term "gene", as sometimes used generically, can also include nucleic acid molecules comprising cDNA and cDNA clones.

"Recombinant DNA" means a molecule that has been engineered by splicing in vitro a cDNA or genomic DNA sequence or altering a sequence by methods such as PCR mutagenesis.

"Cloning" refers to the use of in vitro recombination techniques to insert a particular gene or other DNA sequence into a vector molecule. In order to successfully clone a desired gene, it is necessary to use methods for generating DNA fragments, for joining the fragments to vector molecules, for introducing the composite DNA molecule into a host cell in which it can, replicate, and for selecting the clone having the target gene from amongst the recipient host cells.

"cDNA library" refers to a collection of recombinant DNA molecules containing cDNA inserts which together comprise the entire or a partial repertoire of genes expressed in a particular tissue or cell source. Such a cDNA library can be prepared by methods known to one skilled in the art and described by, for example, Cowell and Austin, "cDNALibrary Protocols," *Methods in Molecular Biology* (1997).

"Cloning vehicle" refers to a plasmid or phage DNA or other DNA sequence which is able to replicate in a host cell. This term can also include artificial chromosomes such as BACs and YACs. The cloning vehicle is characterized by one or more endonuclease recognition sites at which such DNA sequences may be cut in a determinable fashion without loss of an essential biological function of the DNA, which may contain a marker suitable for use in the identification of transformed cells.

"Expression" refers to the process comprising transcription of a gene sequence and subsequent processing steps, such as translation of a resultant mRNA to produce the final end product of a gene. The end product may be a protein (such as an enzyme or receptor) or a nucleic acid (such as a tRNA, antisense RNA, or other regulatory factor). The term "expression control sequence" refers to a sequence of nucleotides that control or regulate expression of structural genes when operably linked to those genes. These include, for example, the lac systems, the trp system, major operator and promoter regions of the phage lambda, the control region of fd coat protein and other sequences known to control the expression of genes in prokaryotic or eukaryotic cells. Expression control sequences will vary depending on whether the vector is designed to express the operably linked gene in a prokaryotic or eukaryotic host, and may contain transcriptional elements such as enhancer elements, termination sequences, tissue-specificity elements and/or translational initiation and termination sites.

"Expression vehicle" refers to a vehicle or vector similar to a cloning vehicle but which is capable of expressing a gene which has been cloned into it, after transformation into a host.

The cloned gene is usually placed under the control of (i.e., operably linked to) an expression control sequence.

"Operator" refers to a DNA sequence capable of interacting with the specific repressor, thereby controlling the transcription of adjacent gene(s).

"Promoter" refers to a DNA sequence that can be recognized by an RNA polymerase. The presence of such a sequence permits the RNA polymerase to bind and initiate transcription of operably linked gene sequences.

"Promoter region" is intended to include the promoter as well as other gene sequences which may be necessary for the initiation of transcription. The presence of a promoter region is sufficient to cause the expression of an operably linked gene sequence. The term "promoter" is sometimes used in the art to generically indicate a promoter region. Many different promoters are known in the art which direct expression of a gene in a certain cell types. Tissue-specific promoters can comprise nucleic acid sequences which cause a greater (or decreased) level of expression in cells of a certain tissue type.

"Operably linked" means that the promoter controls the initiation of expression of the gene. A promoter is operably linked to a sequence of proximal DNA if upon introduction into a host cell the promoter determines the transcription of the proximal DNA sequence(s) into one or more species of RNA. A promoter is operably linked to a DNA sequence if the promoter is capable of initiating transcription of that DNA sequence.

"Prokaryote" refers to all organisms without a true nucleus, including bacteria.

"Eukaryote" refers to organisms and cells that have a true nucleus, including mammalian cells.

"Host" includes prokaryotes and eukaryotes, such as yeast and filamentous fungi, as well as plant and animal cells. The term includes an organism or cell that is the recipient of a replicable expression vehicle.

The term "animal" is used herein to include all vertebrate animals, except humans. It also includes an individual animal in all stages of development, including embryonic and fetal stages. Preferred animals include higher eukaryotes such as avians, rodents (e.g., mice, rabbits, rats, chinchillas, guinea pigs, hamsters and the like), and mammals. Preferred mammals include bovine, equine, feline, canine, ovine, caprine, porcine, buffalo, humans, and primates.

A "transgenic animal" is an animal containing one or more cells bearing genetic information received, directly or indirectly, by deliberate genetic manipulation or by inheritance from a manipulated progenitor at a subcellular level, such as by microinjection or infection with a recombinant viral vector (e.g., adenovirus, retrovirus, herpes virus, adeno-associated virus, lentivirus). This introduced DNA molecule may be integrated within a chromosome, or it may be extra-chromosomally replicating DNA.

"Embryonic stem cells" or "ES cells" as used herein are cells or cell lines usually derived from embryos which are pluripotent meaning that they are un-differentiated cells. These cells are also capable of incorporating exogenous DNA by homologous recombination and subsequently developing into any tissue in the body when incorporated into a host embryo. It is possible to isolate pluripotent cells from sources other than embryonic tissue by methods which are well understood in the art.

Embryonic stem cells in mice have enabled researchers to select for transgenic cells and perform gene targeting. This allows more genetic engineering than is possible with other transgenic techniques. For example, mouse ES cells are relatively easy to grow as colonies in vitro. The cells can be transfected by standard procedures and transgenic cells clonally selected by antibiotic resistance. See, for example, Doetschman et al., 1994, Gene transfer in embryonic stem cells. In Pinkert (Ed.) *Transgenic Animal Technology: A Laboratory Handbook.* Academic Press Inc., New York, pp. 115-146. Furthermore, the efficiency of this process is such that sufficient transgenic colonies (hundreds to thousands) can be produced to allow a second selection for homologous recombinants. Mouse ES cells can then be combined with a normal host embryo and, because they retain their potency, can develop into all the tissues in the resulting chimeric animal, including the germ cells. The transgenic modification can then be transmitted to subsequent generations.

Methods for deriving embryonic stem (ES) cell lines in vitro from early preimplantation mouse embryos are well known. See for example, Evans et al., 1981 *Nature* 29: 154-6 and Martin, 1981, *Proc. Nat Acad. Sci. USA,* 78: 7634-8. ES cells can be passaged in an undifferentiated state, provided that a feeder layer of fibroblast cells or a differentiation inhibiting source is present.

The term "somatic cell" indicates any animal or human cell which is not a sperm or egg cell or is capable of becoming a sperm or egg cell. The term "germ cell" or "germ-line cell" refers to any cell which is either a sperm or egg cell or is capable of developing into a sperm or egg cell and can therefore pass its genetic information to offspring. The term "germ cell-line transgenic animal" refers to a transgenic animal in which the genetic information was incorporated in a germ line cell, thereby conferring the ability to transfer the information to offspring. If such offspring in fact possess some or all of that information, then they, too, are transgenic animals.

The genetic alteration of genetic information may be foreign to the species of animal to which the recipient belongs, or foreign only to the particular individual recipient. In the last case, the altered or introduced gene may be expressed differently than the native gene.

"Fragment" of a gene refers to any portion of a gene sequence. A "biologically active fragment" refers to any portion of the gene that retains at least one biological activity of that gene. For example, the fragment can perhaps hybridize to its cognate sequence or is capable of being translated into a polypeptide fragment encoded by the gene from which it is derived.

"Variant" refers to a gene that is substantially similar in structure and biological activity or immunological characteristics to either the entire gene or to a fragment of the gene. Provided that the two genes possess a similar activity, they are considered variant as that term is used herein even if the sequence of encoded amino acid residues is not identical. Preferentially, as used herein (unless otherwise defined) the variant is one of LRP5, HBM or LRP6. The variant preferably is one that yields an HBM-like phenotype (i.e., enhances bones mass and/or modulates lipid levels). These variants include missense mutations, single nucleotide polymorphisms (SNPs), mutations which result in changes in the amino acid sequence of the protein encoded by the gene or nucleic acid, and combinations thereof, as well as corn in the exon domains of the HBM gene and mutations in LRP5 or LRP6 which result in an HBM like phenotype.

"Amplification of nucleic acids" refers to methods such as polymerase chain reaction (PCR), ligation amplification (or ligase chain reaction, LCR) and amplification methods based on the use of Q-beta replicase. These methods are well known in the art and described, for example, in U.S. Pat. Nos. 4,683, 195 and 4,683,202. Reagents and hardware for conducting PCR are commercially available. Primers useful for amplifying sequences from the HBM region are preferably complementary to, and hybridize specifically to sequences in the HBM region or in regions that flank a target region therein. HBM sequences generated by amplification may be sequenced directly. Alternatively, the amplified sequence(s) may be cloned prior to sequence analysis.

"Antibodies" may refer to polyclonal and/or monoclonal antibodies and fragments thereof, and immunologic binding equivalents thereof, that can bind to the HBM proteins and fragments thereof or to nucleic acid sequences from the HBM region, particularly from the HBM locus or a portion thereof. Preferred antibodies also include those capable of binding to LRP5, LRP6 and HBM variants. Th e term antibody is used both to refer to a homogeneous molecular entity, or a mixture such as a serum product made up of a plurality of different molecular entities. Proteins may be prepared synthetically in a protein synthesizer and coupled to a carrier molecule and injected over several months into rabbits. Rabbit sera is tested for immunoreactivity to the HBM protein or fragment. Monoclonal antibodies may be made by injecting mice with the proteins, or fragments thereof. Monoclonal antibodies will be screened by ELISA and tested for specific immunoreactivity with HBM protein or fragments thereof. Harlow et al., *Antibodies: A Laboratory Manual*, Cold Spring Harbor Laboratory, Cold Spring Harbor, N.Y. (1988) and *Using Antibodies: A Laboratory Manual*, Harlow, Ed and Lane, David (Cold Spring Harbor Press, 1999). These antibodies will be useful in assays as well as pharmaceuticals. By "antibody" is meant to include but rot limited to polyclonal, monoclonal, chimeric, human, humanized, bispecific, multispecific, primatized™ antibodies.

"HBM protein" refers to a protein that is identical to a Zmax1 (LRP5) protein except that it contains an alteration of glycine 171 to a valine. An HBM protein is defined for any organism that encodes a Zmax1 (LRP5) true homolog. For example, a mouse HBM protein refers to the mouse Zmax1 (LRP5) protein having the glycine 170 to valine substitution.

By "HBM-like" is meant a variant of LRP5, LRP6 or HBM which when expressed in a cell is capable of modulating bone mass, lipid levels, Dkk activity, and/or Wnt activity.

In one embodiment of the present invention, "HBM gene" refers to the genomic DNA sequence found in individuals showing the HBM characteristic or phenotype, where the sequence encodes the protein indicated by SEQ ID NO: 4. The HBM gene and the Zmax1 (LRP5) gene are allelic. The protein encoded by the HBM gene has the property of causing elevated bone mass, while the protein encoded by the Zmax1 (LRP5) gene does not. The HBM gene and the Zmax1 (LRP5) gene differ in that the HBM gene has a thymine at position 582, while the Zmax1 gene has a guanine at position 582. The HBM gene comprises the nucleic acid sequence shown as SEQ ID NO: 2. The HBM gene may also be referred to as an "HBM polymorphism." Other HBM genes may further have silent mutations, such as those discussed in Section 3 below.

In alternative embodiments of the present invention, "HBM gene" may also refer to any allelic variant of Zmax1 (LRP5) or LRP6 which results in the HBM phenotype. Such variants may include alteration from the wild-type protein coding sequence as described herein and/or alteration in expression control sequences of Zmax1 (LRP5) or contains an amino acid mutation in LRP5 or LRP6, such that the resulting protein produces a phenotype which enhances bone mass and/or modulates lipid levels. A preferred example of such a variant is an alteration of the endogenous Zmax1 (LRP5) promoter region resulting in increased expression of the Zmax1 (LRP5) protein.

"Normal," "wild-type," "unaffected", "Zmax1", "Zmax", "LR3" and "LRP5" all refer to the genomic DNA sequence that encodes the protein indicated by SEQ ID NO: 3. LRP5 has also been referred to LRP7 in mouse. Zmax1, LRP5 and Zmax may be used interchangeably throughout the specification and are meant to be the same gene, perhaps only relating to the gene in a different organism. The Zmax1 gene has a guanine at position 582 in the human sequence. The Zmax1 gene of human comprises the nucleic acid sequence shown as SEQ ID NO: 1. "Normal," "wild-type," "unaffected", "Zmax1" and "LRP5" also refer to allelic variants of the genomic sequence that encodes proteins that do not contribute to elevated bone mass. The Zmax1 (LRP5) gene is common in the human population, while the HBM gene is rare.

"Bone development" generally refers to any process involved in the change of bone over time, including, for example, normal development, changes that occur during disease states, and changes that occur during aging. This may refer to structural changes and dynamic rate changes such as growth rates, resorption rates, bone repair rates, and etc. "Bone development disorder" particularly refers to any disorders in bone development including, for example, changes that occur during disease states and changes that occur during aging. Bone development may be progressive or cyclical in nature. Aspects of bone that may change during development include, for example, mineralization, formation of specific anatomical features, and relative or absolute numbers of various cell types.

"Bone modulation" or "modulation of bone formation" refers to the ability to affect any of the physiological processes involved in bone remodeling, as will be appreciated by one skilled in the art, including, for example, bone resorption and appositional bone growth, by, inter alia, osteoclastic and osteoblastic activity, and may comprise some or all of bone formation and development as used herein.

Bone is a dynamic tissue that is continually adapting and renewing itself through the renewal of old or unnecessary bone by osteoclasts and the rebuilding of new bone by osteoblasts. The nature of the coupling between these processes is responsible for both the modeling of bone during growth as well as the maintenance of adult skeletal integrity through remodeling and repair to meet the everyday needs of mechanical usage. There are a number of diseases that result from an uncoupling of the balance between bone resorption and formation. With aging there is a gradual "physiologic" imbalance in bone turnover, which is particularly exacerbated in women due to menopausal loss of estrogen support, that leads to a progressive loss of bone. As bone mineral density falls below population norms there is a consequent increase in bone fragility and susceptibility to spontaneous fractures. For every 10 percent of bone that is lost, the risk of fracture doubles. Individuals with bone mineral density (BMD) in the spine or proximal femur 2.5 or more standard deviations below normal peak bone mass are classified as osteoporotic. However, osteopenic individuals with BMD between 1 and 2.5 standard deviations below the norm are clearly at risk.

Bone is measured by several different forms of X-ray absorptiometry. All of the instruments measure the inorganic or bone mineral content of the bone. Standard DXA measurements give a value that is an areal density, not a true density measurement by the classical definition of density (mass/unit volume). Nevertheless, this is the type of measurement used clinically to diagnose osteoporosis. However, while BMD is a major contributing factor to bone strength, as much as 40% of bone strength stems from other factors including: 1) bone size (i.e., larger diameters increase organ-level stiffness, even in the face of lower density); 2) the connectivity of trabecular structures; 3) the level of remodeling (remodeling loci are local concentrators of strain); and 4) the intrinsic strength of the bony material itself, which in turn is a function of loading history (i.e., through accumulated fatigue damage) and the extent of collagen cross-linking and level of mineralization. There is good evidence that all of these strength/fragility factors play some role in osteoporotic fractures, as do a host of extraskeletal influences as well (such as fall patterns, soft tissue padding, and central nervous system reflex responsiveness).

Additional analytical instruments can be used to address these features of bone. For example, the pQCT allows measurement of separate trabecular and cortical compartments for size and density and the µCT provides quantitative information on architectural features such as trabecular connectivity. The µCT also gives a true bone density measurement. With these tools, the important non-BMD parameters can be measured for diagnosing the extent of disease and the efficacy of treatments. Current treatments for osteoporosis are based on the ability of drugs to prevent or retard bone resorption. Although newer anti-resorptive agents are proving to be useful in the therapy of osteoporosis, they are viewed as short-term solutions to the more definitive challenge to develop treatments that will increase bone mass and/or the bone quality parameters mentioned above.

Thus, bone modulation may be assessed by measuring parameters such as bone mineral density (BMD) and bone mineral content (BMC) by pDXA X-ray methods, bone size, thickness or volume as measured by X-ray, bone formation rates as measured for example by calcien labeling, total, trabecular, and mid-shaft density as measured by pQCT and/ or µCT methods, connectivity and other histological parameters as measured by µCT methods, mechanical bending and compressive strengths as preferably measured in femur and vertebrae respectively. Due to the nature of these measurements, each may be more or less appropriate for a given situation as the skilled practitioner will appreciate. Furthermore, parameters and methodologies such as a clinical history of freedom from fracture, bone shape, bone morphology, connectivity, normal histology, fracture repair rates, and other bone quality parameters are known and used in the art. Most preferably, bone quality may be assessed by the compressive strength of vertebra when such a measurement is appropriate. Bone modulation may also be assessed by rates of change in the various parameters. Most preferably, bone modulation is assessed at more than one age.

"Normal bone density" refers to a bone density within two standard deviations of a Z score of 0 in the context of the HBM linkage study. In a general context, the range of normal bone density parameters is determined by routine statistical methods. A normal parameter is within about 1 or 2 standard desviations of the, age and sex normalized parameter, preferably about 2 standard deviations. A statistical measure of meaningfulness is the P value which can represent the likelihood that the associated measurement is significantly different from the mean. Significant P values are $P<0.05$, 0.01, 0.005, and 0.001, preferably at least $P<0.01$.

"HBM" refers to "high bone mass" although this term may also be expressed in terms of bone density, mineral content, and size.

"HBM phenotype" and "HBM-like phenotype" may be characterized by an increase of about 2 or more standard deviations, preferably 2, 2.5, 3, or more standard deviations in 1, 2, 3, 4, 5, or more quantitative parameters of bone modulation, preferably bone density and mineral content and bone strength parameters, above the age and sex norm for that parameter. The HBM phenotype and HBM-like phenotype are characterized by statistically significant increases in at least one parameter, preferably at least 2 parameters, and more preferably at least 3 or more parameters. The HBM phenotype and the HBM-like phenotype may also be characterized by an increase in one or more bone quality parameters and most preferably increasing parameters are not accompanied by a decrease in any bone quality parameters. Most preferably, an increase in bone modulation parameters and/or bone quality measurements is observed at more than one age. The HBM phenotype and HBM-like phenotype also includes changes of lipid levels, Wnt activity and/or Dkk activity.

The terms "isolated" and "purified" refer to a substance altered by hand of man from the natural environment. An isolated peptide may be for example in a substantially pure form or otherwise displaced from its native environment such as by expression in an isolated cell line or transgenic animal. An isolated sequence may for example be a molecule in substantially pure form or displaced from its native environment such that at least one end of said isolated sequence is not contiguous with the sequence it would be contiguous with in nature.

"Biologically active" refers to those forms of proteins and polypeptides, including conservatively substituted variants, alleles of genes encoding a protein or polypeptide fragments of proteins which retain a biological and/or immunological activity of the wild-type protein or polypeptide. Preferably the activity is one which induces a change in Dkk activity, such as inhibiting the interaction of Dkk with a ligand binding partner (e.g., LRP5 or LRP6 or Dkk-1 with a Dkk-1 interacting protein such as those shown in FIG. 5). By biologically active is also meant to include any form which modulates Wnt signaling.

By "modulate" and "regulate" is meant methods, conditions, or agents which increase or decrease the wild-type activity of an enzyme, inhibitor, signal transducer, receptor, transcription activator, co-factor, and the like. This change in activity can be an increase or decrease of mRNA translation, mRNA or DNA transcription, and/or mRNA or protein degradation, which may in turn correspond to an increase or decrease in biological activity.

By "modulated activity" is meant any activity, condition, disease or phenotype which is modulated by a biologically active form of a protein. Modulation may be effected by affecting the concentration or subcellular localization of biologically active protein, i.e., by regulating expression or degradation, or by direct agonistic or antagonistic effect as, for example, through inhibition, activation, binding, or release of substrate, modification either chemically or structurally, or by direct or indirect interaction which may involve additional factors.

By "effective amount" or "dose effective amount" or "therapeutically effective amount" is meant an amount of an agent which modulates a biological activity of the polypeptide of the invention.

By "immunologically active" is meant any immunoglobulin protein or fragment thereof which recognizes and binds to an antigen.

By "Dkk" is meant to refer to the nucleic acids and proteins of members of the Dkk (Dickkopf) family. This includes, but is not limited to, Dkk-1, Dkk-2, Dkk-3, Dkk-4, Soggy, and related Dkk proteins. Dkk-1 is a preferred embodiment of the present invention. However, the Dkk proteins have substantial homology and one skilled in the art will appreciate that all of the embodiments of the present invention utilizing Dkk-1 may also p be utilized with the other Dkk proteins.

By "Dkk-1" is meant to refer to the Dkk-1 protein and nucleic acids which encode the Dkk-1 protein. Dkk-1 refers to Dickkopf-1, and in *Xenopus* it is related to at least Dkk-2, Dkk-3, and Dkk-4 (see Krupnik et al., *Gene* 238:301-313 (1999)). Dkk-1 was first identified in *Xenopus* (Glinka et al.,

*Nature* 391:357-62 (1998)). It was recognized as a factor capable of inducing ectopic head formation in the presence of inhibition of the BMP pathway. It was then also found to inhibit the axis-inducing activity of several *Xenopus* Wnt molecules by acting as an extracellular antagonist of Wnt signaling. Mammalian homologs have been found including Dkk-1, Dkk-2, Dkk-3, Dkk-4 and soggy (Fedi et al., 1999 and Krupnick et al. 1999). Human Dkk-1 was also referred to as sk (Fedi et al. 1999). As used herein, Dkk-1 is meant to include proteins from any species having a Wnt pathway in which Dkk-1 interacts. Particularly preferred are mammalian species (e.g., murine, caprine, canine, bovine, feline, equine, primate, ovine, porcine and the like), with particularly preferred mammals being humans. Nucleic acid sequences encoding Dkk-1 include, but are not limited to human Dkk-1 (GenBank Accession Nos. AH009834, XM_005730, AF261158, AF261157, AF177394, AF127563 and NM_012242), *Mus musculus* dickkopf homolog 1 (GenBank Accession No. NM_010051), and *Danio rerio* dickkopf-1 (GenBank Accession Nos. AF116852 and AB023488). The genomic sequences with exon annotation are GenBank Accession Nos. AF261157 and AF261158. Also contemplated are homologs of these sequences which have Dkk-1 activity in the Wnt pathway. Dkk-1 amino acid sequences include, but are not limited to human dickkopf homolog 1 (GenBank Accession Nos. AAG15544, BM34651, NP_036374, MF02674, AAD21087, and XP_005730), *Danio rerio* (zebrafish) dickkopf1 (GenBank Accession Nos. BAA82135 and MD22461) and murine dickkopf-1 (GenBank Accession Nos. 054908 and NP_034181). Variants and homologs of these sequences which possess Dkk-1 activity are also included when referring to Dkk-1.

By "Dkk mediated" disorder, condition or disease is any abnormal state that involves Dkk activity. The abnormal state can be induced by environmental exposure or drug administration. Alternatively, the disease or disorder can be due to a genetic defect. Dkk mediated diseases, disorders and conditions include but are not limited to bone mass disorders or conditions and lipid disorders and conditions. For example, bone mass disorders/conditions/diseases, which may be mediated by Dkk, include but are not limited to age related loss of bone, bone fractures (e.g., hip fracture, Colle's fracture, vertebral crush fractures), chondrodystrophies, drug-induced disorders (e.g., osteoporosis due to administration of glucocorticoids or heparin and osteomalacia due to administration of aluminum hydroxide, anticonvulsants, or glutethimide), high bone turnover, hypercalcemia, hyperostosis, osteogenesis imperfecta, osteomalacia, osteomyelitis, osteoporosis, Paget's disease, osteoarthritis, and rickets.

Lipid disorders/diseases/conditions, which may be mediated by Dkk, include but are not limited to familial lipoprotein lipase deficiency, familial apoprotein CII deficiency, familial type 3 hyperlipoproteinemia, familial hypercholesterolemia, familial hypertriglyceridemia, multiple lipoprotein-type hyperlipidemia, elevated lipid levels due to dialysis and/or diabetes, and elevated lipid levels of unknown etiologies The term "recognizes and binds," when used to define interactions of antisense nucleotides, siRNAs (small inhibitory RNA), or shRNA (short hairpin RNA) with a target sequence, means that a particular antisense, siRNA, or shRNA sequence is substantially complementary to the target sequence, and thus will specifically bind to a portion of an mRNA encoding polypeptide. As such, typically the sequences will be highly complementary to the mRNA target sequence, and will have no more than 1, 2, 3, 4, 5, 6, 7, 8, 9, or 10 base mismatches throughout the sequence. In many instances, it may be desirable for the sequences to be exact matches, i.e. be completely complementary to the sequence to which the oligonucleotide specifically binds, and therefore have zero mismatches along the complementary stretch. As such, highly complementary sequences will typically bind quite specifically to the target sequence region of the mRNA and will therefore be highly efficient in reducing, and/or even inhibiting the translation of the target MRNA sequence into polypeptide product.

Substantially complementary oligonucleotide sequences will be greater than about 80 percent complementary (or '% exact-match') to the corresponding mRNA target sequence to which the oligonucleotide specifically binds, and will, more preferably be greater than about 85 percent complementary to the corresponding mRNA target sequence to which the oligonucleotide specifically binds. In certain aspects, as described above, it will be desirable to have even more substantially complementary oligonucleotide sequences for use in the practice of the invention, and in such instances, the oligonucleotide sequences will be greater than about 90 percent complementary to the corresponding mRNA target sequence to which the oligonucleotide specifically binds, and may in certain embodiments be greater than about 95 percent complementary to the corresponding mRNA target sequence to which the oligonucleotide specifically binds, and even up to and including 96%, 97%, 98%, 99%, and even 100% exact match complementary to the target mRNA to which the designed oligonucleotide specifically binds.

Percent similarity or percent complementary of any of the disclosed sequences may be determined, for example, by comparing sequence information using the GAP computer program, version 6.0, available from the University of Wisconsin Genetics Computer Group (UWGCG). The GAP program utilizes the alignment method of Needleman and Wunsch (1970). Briefly, the GAP program defines similarity as the number of aligned symbols (i.e., nucleotides or amino acids) which are similar, divided by the total number of symbols in the shorter of the two sequences. The preferred default parameters for the GAP program include: (1) a unary comparison matrix (containing a value of 1 for identities and 0 for non-identities) for nucleotides, and the weighted comparison matrix of Gribskov and Burgess (1986), (2) a penalty of 3.0 for each gap and an additional 0.10 penalty for each symbol in each gap; and (3) no penalty for end gaps.

By "mimetic" is meant a compound or molecule that performs the same function or behaves similarly to the compound mimicked.

By "reporter element" is meant a polynucleotide that encodes a poplypeptide capable of being detected in a screening assays. Examples of polypeptides encoded by reporter elements include, but are not limited to, lacZ, GFP, luciferase, and chloramphenicol acetyltransferase.

2. Introduction

A polymorphism in LRP5 (Zmax), G171V, designated as HBM, has been identified as conferring a high bone mass phenotype in a population of related subjects as described in co-pending applications International Patent Application PCT/US 00/16951, and U.S. patent application Ser. Nos. 09/543,771 and 09/544,398, which are hereby incorporated by reference in their entirety (Little et al., *Am J Hum Genet* 70:11-19 (2002)). LRP5 is also described in International Patent Application WO 98/46743, which is incorporated by reference in its entirety. Loss of LRP5 function has been shown to have a deleterious effect on bone (Gong et al., *Cell* 107:513-523 (2001)). Additionally, the HBM polymorphism and LRP5 may also be important in cardiac health and lipid-mediated disorders. Thus, methods of regulating their activity can serve as methods of treating and/or preventing cardiac and lipid-mediated disorders.

Figure 1:
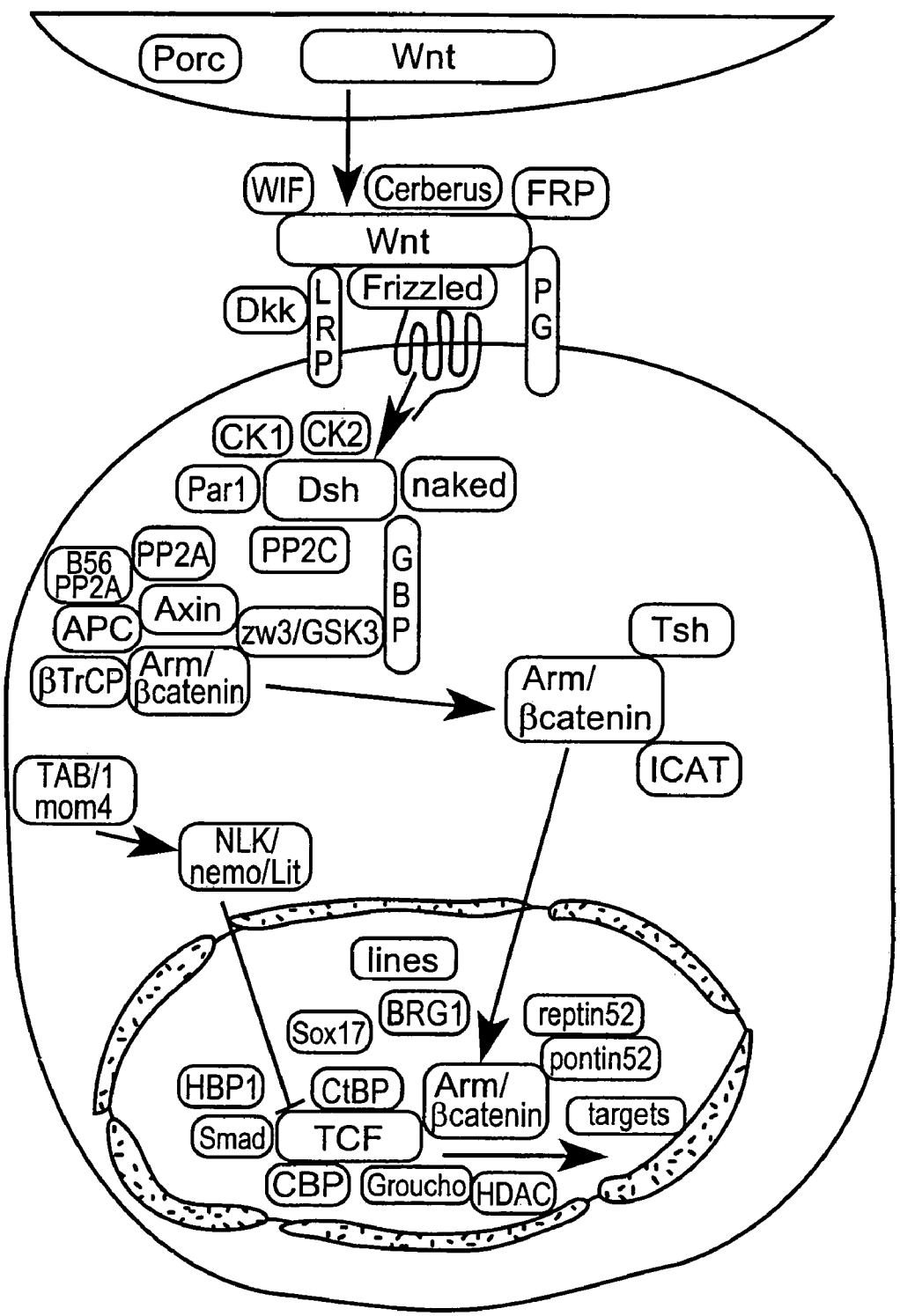

Recent studies have indicated that LRP5 participates in the Wnt signal transduction pathway. The Wnt pathway is critical in limb early embryological development. A recently published sketch of the components of Wnt signaling is shown in FIG. 1

(Nusse, 2001 http://www.stanford.edu/~musse/pathways/cell2.html) (see also, Nusse, *Nature* 411:255-6 (2001); and Mao et al., *Nature* 411:321-5 (2001)). Briefly summarized, Wnt proteins are secreted proteins which interact with the transmembrane protein Frizzled (Fz). LRP proteins, such as LRP5 and LRP6, are believed to modulate the Wnt signal in a complex with Fz (Tamai et al., *Nature* 407:530-5 (2000)). The Wnt pathway acts intracellularly through the Disheveled protein (Dsh) which in turn inhibits glycogen synthetase kinase-3 (GSK3) from phosphorylating β-catenin. Phosphorylated β-catenin is rapidly degraded following ubiquitination. However, the stabilized β-catenin accumulates and translocates to the nucleus where it acts as a cofactor of the T-cell factor (TCF) transcription activator complex.

The protein dickkopf-1 (Dkk-1) is reported to be an antagonist of Wnt pathway. Dkk-1 is required for head formation in early development. Dkk-1 and its function in the Wnt pathway are described in e.g., Krupnik, et al., *Gene* 238:301-13 (1999); Fedi et al., *J. Biol. Chem.* 274:19465-72 (1999); see also for Dkk-1 and the Wnt pathway, Wu et al., *Curr. Biol* 10:1611-4 (2000), Shinya et al., *Mech. Dev.* 98:3-17 (2000), Mukhopadhyay et al., *Dev Cell* 1:423-434 (2001) and in PCT Patent Application No. WO 00/52047, and in references cited in each. It has been known that Dkk-1 acts upstream of Dsh, however the nature of the mechanism of inhibition by Dkk-1 is just beginning to be elucidated. Dkk-1 is expressed in the mouse embryonic limb bud and its disruption results in abnormal limb morphogenesis, among other developmental defects (Gotewold et al., *Mech. Dev.* 89:151-3 (1999); and, Mukhopadhyay et al., *Dev Cell* 1:423-434 (2001)).

Related U.S. provisional application 60/291,311 disclosed a novel interaction between Dkk-1 (GenBank Accession No. XM 005730) and LRP5. The interaction between Dkk-1 and LRP5 was discovered by a yeast two hybrid (Y2H) screen for proteins which interact with the ligand binding domain of LRP5, as described in Example 1. The two-hybrid screen is a common procedure in the art, which is described, for example, by Gietz et al., *Mol. Cell. Biochem.* 172:67-79 (1997); Young, *Biol. Reprod.* 58:302-11 (1998); Brent and Finley, *Ann. Rev. Genet.* 31:663-704 (1997); and Lu and Hannon, eds., *Yeast Hybrid Technologies, Eaton.* Publishing, Natick Mass., (2000). More recently, other studies confirm that Dkk-1 is a binding partner for LRP and modulates the Wnt pathway via direct binding with LRP (R. Nusse, *Nature* 411:255-256(2001); A. Bafico et al., *Natl. Cell Biol.* 3:683-686 (2001); M. Semënov, *Curr. Biol.* 11:951-961 (2001); B. Mao, *Nature* 411:321-325 (2001), Zorn, *Curr. Biol.* 11:R592-5 (2001)); and, L. Li et al., *J. Biol Chem.* 277:5977-81 (2002)).

Mao and colleagues (2001) identified Dkk-1 as a ligand for LRP6. Mao et al. suggest that Dkk-1 and LRP6 interact antagonistically where Dkk proteins inhibit the Wnt coreceptor functions of LRP6. Using co-immunoprecipitation, the group verified that the Dkk-1/LRP6 interaction was direct. Dkk-2 was also found to directly bind LRP6. Contrary to data contained in provisional application 60/291,311, Mao et al. report that no interaction was detected between any Dkk protein and LRP5, as well as no interaction with LDLR, VLDLR, ApoER, or LRP). Additionally, Mao et al. demonstrated that LRP6 can titrate Dkk-1's effects of inhibiting Wnt signaling using the commercial TCF-luciferase reporter gene assay (TOPFLASH). A similar conclusion was drawn from analogous studies in *Xenopus* embryos. Deletion analyses of LRP6 functional domains revealed that EGF repeats (beta-propellers) 3 and 4 were necessary for Dkk-1 binding and that the ligand binding domains of LRP6 had no effect on Dkk-1 binding. The findings of Mao et a contrast with data obtained by the present inventors indication that the ligand binding domains of LRP5 were necessary and sufficient for Dkk-1 binding in yeast. Using classical biochemical ligand-receptor studies, Mao et al. determined a Kd=0.34 nM for Dkk-1/LRP6 and a Kd=0.73 nM for Dkk-2/LRP6.

Semenov et al. (2001) verified the Mao group's results and confirmed by coimmunoprecipitation that Dkk-1 does not directly bind to Wnt or Frizzled but rather interacts with LRP6. Their Scatchard analyses found a Kd=0.5 nM for Dkk-1/LRP6. Semenov et al. also demonstrated that Dkk-1 could abolish an LRP5/Frizzled8 complex implying that Dkk-1 can also repress Wnt signaling via interactions with LRP5. A Dkk-1 mutant where cysteine 220 was changed to alanine abolished LRP6 binding and was unable to repress Wnt signaling. Studies in *Xenopus* embryos confirmed the results and revealed a functional consequence of Dkk-1/LRP6: repression of Wnt signaling. Their *Xenopus* work also suggested that LRP6/Dkk-1 may be specific for the canonical, β-catenin-mediated, Wnt pathways as opposed to the Wnt Planar Cell Polarity pathway.

Bafico et al. (2001) employed a $^{125}$I-labeled Dkk-1 molecule to identify LRP6 as its sole membrane receptor with a Kd=0.39 nM. Again, the functional consequences of the Dkk-1/LRP6 interaction was a repression of the canonical Wnt signaling even when Dkk-1 was added at extremely low concentrations (30 pM).

Not wishing to be bound by theory, it is believed that the present invention provides an explanation: for the mechanism of Dkk-1 inhibition of the Wnt pathway and provides a mechanism whereby the Wnt pathway may be modulated. The present application and related provisional application 60/291,311 describe Dkk-1/LRP5 interactions and demonstrate that the interaction between LRP5/LRP6/HBM and Dkk can be used in a method as an intervention point in the Wnt pathway for an anabolic bone therapeutic or a modulator of lipid metabolism.

As detailed below, in the section "Methods to Identify Binding Partners" and Examples 6 and 7, Dkk-1 is able to repress LRP5-mediated Wnt signaling but not HBM-mediated Wnt signaling. This observation is of particular interest because the HBM mutation in LRP5 is a gain of function or activation mutation. That is, Wnt signaling, via the canonical pathway, is enhanced with HBM versus LRP5. The present data suggest the mechanism of this functional activation: the inability of Dkk-1 to repress HBM-mediated Wnt signaling. Further investigations of other Wnt or Dkk family members show differential activities in the canonical Wnt pathway that demonstrate the complexity and variability in Wnt signaling that can be achieved depending on the LRP/Dkk/Wnt/Frizzled repertoire that is expressed in a particular cell or tissue. This may attest to the apparent bone specificity of the HBM phenotype in humans and in the HBM transgenic animals.

Furthermore, the present data reveal the importance and functional consequence for the potential structural perturbation of the first beta-propeller domain of LRP5. Our data identified the ligand binding domain of LRP5 as the interacting region with Dkk-1 while the Mao et al. publication demonstrated the functional role of propellers 3 and 4 in their LRP6/Dkk-1 studies. In the present invention, we implicate the first beta propeller domain, via the HBM mutation at residue 171, as having a functional consequence in the Dkk-1-mediated Wnt pathway. The involvement of position 171 of propeller 1 may be direct or indirect with Dkk-1. Direct involvement could arise from perturbations of the 3-dimensional structure of the HBM extracellular domain that render Dkk-1 unable to bind. Alternatively, residue 171 of propeller 1 may directly interact with Dkk-1; however, by itself, it is insufficient to bind and requires other LRP5 domains. Potential indirect candidate molecules may be among the proteins, identified the Dkk-1 yeast-two-hybrid experiments.

It may be that the disruption of Dkk activity is not necessarily mediated by enhancing or preventing the binding of Dkk to LRP5/LRP6/HBM. More than one mechanism may be involved. Indeed, the inventors have observed that Dkk-1 binds LRP5, LRP6, and HBM. It is able to effectively inhibit LRP6, and to a slightly lesser extent, LRP5 activity. Further, has been observed that different members of the Dkk family differentially affect LRP5/LRP6/HBM activity. For example, Dkk-1 inhibits LRP5/LRP6/HBM activity while another Dkk may enhance LRP5/LRP6/HBM activity. An endpoint to consider is the modulation of the LRP5/LRP6/HBM activity, not simply binding.

The present disclosure shows that targeting the disruption of the Dkk-1/LRP5 interaction is a therapeutic intervention point for an HBM mimetic agent. A therapeutic agent of the invention may be a small molecule, peptide or nucleic acid aptamer, antibody, or other peptide/protein, etc. Methods of reducing Dkk-1 expression may also be therapeutic using methodologies such as: RNA interference, antisense oligonucleotides, morpholino oligonucleotides, PNAs, antibodies to Dkk-1 or Dkk-1 interacting proteins, decoy or scavenger LRP5 or LRP6 receptors, and knockdown of Dkk-1 or Dkk-1 interactor transcription.

In an embodiment of the present invention, the activity of Dkk-1 or the activity of a Dkk-1 interacting protein may be modulated for example by binding with a peptide aptamer of the present invention. In another embodiment, LRP5 activity may be modulated by a reagent provided by the present invention (e.g., a peptide aptamer). In another embodiment, the Dkk-1/LRP5 interaction may be modulated by a reagent of the present invention (e.g., a Dkk-1 interacting protein such as those identified in FIG. 5). In another embodiment, the Wnt signal transduction pathway may be modulated by use of one or more of the above methods. In a preferred embodiment of the present invention, the Dkk-1 mediated activity of the Wnt pathway may be specifically modulated by one or more of the above methods. In another preferred embodiment of the present invention, the Wnt signal transduction pathway may be stimulated by down-regulating Dkk-1 interacting protein activity; such down-regulation could, for example, yield greater LRP5 activity. In a more preferred embodiment, by stimulating LRP5 activity, bone mass regulation may be stimulated to restore or maintain a more optimal level. In another preferred embodiment, by stimulating LRP5 activity, lipid metabolism may be stimulated to restore or maintain a more optimal level. Alternative embodiments provide methods for screening candidate drugs and therapies directed to correction of bone mass disorders or lipid metabolism disorders. And, preferred embodiments of the present invention provide drugs and therapies developed by the use of the reagents and/or methods of the present invention. One skilled in the art will understand that the present invention provides important research tools to develop an effective model of osteoporosis, to increase understanding of bone mass and lipid modulation, and to modulate bone mass and lipid metabolism.

Previous investigation of a large family in which high bone mass is inherited as a single gene (autosomal dominant) trait (HBM-1) has provided important insight into the mechanism by which bone density might be modulated. Members of this family have significantly increased spinal and hip BMD (>3 standard deviations above the norm) which affects young adults as well as elderly family members into the ninth decade. The bones of affected members, while appearing very dense radiographically, have normal external shape and outer dimensions. Cortical bone is thickened on endosteal surfaces and "affected" individuals are asymptomatic without any other phenotypic abnormalities. Assays of biochemical markers that reflect skeletal turnover suggest that the disorder is associated with a normal rate of bone remodeling. Affected individuals have achieved a balance in bone turnover at a density that is significantly greater than necessary for normal skeletal stresses. Importantly, the bones most affected are load-bearing bones which are subjected to the greatest mechanical and gravitational stresses (spine and hip). These are the most important bones to target fir therapeutic interventions in osteoporosis. The gene identified as being responsible for this phenotype, Zmax or LRP5, was not previously associated with bone physiology. The fact that modification of this gene, such as that produced by the polymorphism leading to the autosomal dominant inheritance of the HBM family phenotype, identifies Zmax/LRP5 and the pathway by which it is regulated, including Dkk/Wnt pathways discussed above, as an important target for developing modulators of bone density. Modulation of Zmax/LRP5 to mimic the gain in function provided by the HBM polymorphism would be expected to provide an important therapy for bone wasting conditions. Additionally, such modulation in young adults could enhance peak bone mass and prevent or delay fracture risk later in life. Alternatively, modulation to reduce function could be employed to treat conditions where bone is being inappropriately produced.

3. Polypeptides

Polypeptides contemplated for use in this invention include those which modulate Dkk and Dkk interacting protein activities. Preferred polypeptides and peptides include those which modulate the Wnt pathway. Examples of preferred sequences include the Y2H baits exemplified in FIG. 2, peptide aptarers of FIG. 3 (SEQ ID NOs:171-188) and FIG. 4 (SEQ ID NOs: 189-192), the polypeptides of the Dkk-1 interacting proteins identified in FIG. 5, those polypeptides shown in FIG. 6, the LRP binding domain of Dkk (amino acids 138-266 of hDkk1), the cysteine-rich domain 2 (a.a. 183-245 of hDkk-1), the cysteine-rich domain 1 (a.a. 97-138 of hDkk), and LRP5 binding aptamers of FIG. 13 (including SEQ ID NOs:204-213). Although Dkk-1 is exemplified, the other Dkk proteins contain substantially similar regions and may also be used according to the present invention.

For example, the baits depicted in FIG. 2 were used in a yeast two hybrid (Y2H) screen. The Y2H screen was performed as described in Example 2 to determine the minimum required binding domain for Dkk-1 to bind LRP5. The minimum binding domain constructs (i.e., residues 139-266 in bold below and residues 97-245 which are: underlined, of Dkk-1) include the second cysteine rich domain which has sequence homology to a colipase fold.

```
mmalgaagat rvfvamvaaa lgghpllgvs atlnsvlnsn aiknlppplg gaaghpgsav    60
saapgilypg gnkyqtidny qpypcaedee cgtdeycasp trggdagvqi clacrkrrkr  120
cmrhamccpg nyckngicvs sdqnhfrgei eetitesfgn dhstldgysr rttlsskmyh  180
tkggegsvcl rssdcasglc carhfwskic kpvlkegqvc tkhrrkgshg leifqrcycg  240
eglscriqkd hhqasnssrl htcqrh (GenBank Accession No. XP_005730)(SEQ ID
NO:128).
```

This homology suggests a lipid-binding function and may facilitate Dkk-1 interactions at the plasma membrane (van Tilbeurgh, H., *Biochim. Biophys. Acta.* 1441:173-84 (1999)). An interaction domain of Dkk-1 that is able to interact with the ligand binding-domain (LBD) of LRP5 is a useful reagent in the modulation of LRP5 activity and modulation of Dkk-1/LRP5 complex formation. Similar screens can be prepared for Dkk-1 and Dkk-1 interacting proteins or polypeptides.

A set of peptide aptamers was identified from a library of random peptides constrained and presented in a thioredoxin A (trxA) scaffold as described in Example 3. Peptide aptamers are powerful new tools for molecular medicine as reviewed by Hoppe-Seyler & Butz, *J. Mol. Med.,* 78:426430 (2000); Brody and Gold, *Rev. Mol. Biotech.,* 74:5-13 (2000); and Colas, *Curr. Opin. in Chem. Biol.* 4:54-9 (2000) and the references cited therein. Briefly, peptide aptamers have been shown to be highly specific reagents capable of binding in vivo. As such, peptide aptamers provide a method of modulating the function of a protein and may serve as a substitute for conventional knock-out methods, knock-down or complete loss of function. Peptide aptamers are also useful reagents for the validation of targets for drug development and may be used as therapeutic compounds directly or provide the necessary foundation for drug design. Once identified, the peptide insert may be synthesized and used directly or incorporated into another carrier molecule. References reviewed and cited by Brody and Gold (2000, supra) describe demonstrated therapeutic and diagnostic applications of peptide aptamers and would be known to the skilled artisan.

The peptide aptamers of the present invention are useful reagents in the binding of Dkk-1 to its ligands and thereby modulation of the Wnt pathway and may be used to prevent Dkk-1 from inhibiting LRP5 modulation or Dkk-1 interacting protein modulation of the Wnt pathway. The sequence of these peptide aptamers is shown in FIG. 3 (SEQ ID NOs:171-188). The peptide aptamers refers to the peptide constrained by the thioredoxin scaffold. The aptamers are also contemplated as therapeutic agents to treat Dkk-1 mediated diseases and conditions. Such aptamers are useful structural guides to chemists, for the design of mimetic compounds of the aptamers.

Peptide aptamers were likewise developed to the LRP5 ligand binding domain (LBD) bait sequences. The sequences of these peptide aptamers is shown in FIG. 4 (SEQ ID NOs: 189-192). These are useful reagents which may be used to disrupt the Dkk-1/LRP5 binding interface while leaving Dkk-1 undisturbed. These can be used as comparative controls for Wnt signaling, thus, a control is provided for the specificity of any drug or therapy screened. The aptamers are also useful therapeutic agents to treat LRP mediated diseases and conditions. Such aptamers may also be used as structural guides to chemists, for the design of mimetic compounds of the aptamers.

Thirty proteins were identified which interact with Dkk-1, Dkk-1 interacting proteins, were identified in a yeast-two-hybrid screen using the Dkk-1 bait and are shown in FIG. 5. It was noted that these results suggest an interaction of Dkk-1 with Notch-2. It has been suggested that cross-talk exists between the Wnt and Notch signaling pathways. For instance, Presenilin1 (Ps1) is required for Notch processing and inhibits the downstream Wnt pathway. The extracellular domain of Notch is thought to interact with Wnt. Furthermore, the Notch intracellular domain is thought to interact with disheveled and in signal induced processing, the intracellular domain is thought to interact with presenilin. (Soriano et al., *J. Cell Biol.* 152:785-94 (2001)). For additional information regarding the relationships between Notch and Wnt signaling, see Wesley, *Mol. Cell. Biol.* 19:5743-58 (1999) and Axelrod et al., *Science* 271:1826-32 (1996).

An interaction between Dkk-1 and chordin has also been noted; suggesting that cross-talk exists between the Wnt and TGF-beta/BMP signaling pathways (Letamendia et al., *J. Bone Joint Surg. Am.* 83A:S31 (2001): Labbe et al., *Proc. Natl Acad. Sci. USA* 97:8358-63 (2000); Nishita et al., *Nature* 403:781-5 (2000); DeRobertis et al., *Int. J. Dev. Biol.* 45:1389-97 (2001); and Saint-Jeannet et al., *Proc. Natl. Acad. Sci. USA* 94:13713-8 (1997)). The BMP signaling pathway has an established role in bone and connective tissue development, repair and homeostasis (review in Rosen and Wozney "Bone Morphogenetic Proteins" In: Principles of Bone Biology, 2$^{nd}$ Edition, Eds. J. Bilezikian, L. Raisz and G. Rodan, Academic Press, pp. 919-28 (2002)). Chordin is an important molecule during development which also modulates BMP signaling in adults by sequestering BMPs in latent complexes (Piccolo et al., *Cell* 86:589-9.8 (1996) reviewed in Reddi, *Arthritis Res.* 3:1-5 (2001); DeRobertis et al., *Int. J. Dev. Biol.* 45:189-97 (2001)). It may be that Dkk effects bone mass modulation through both the Wnt signaling pathway via LRP and the BMP pathway via chordin.

Moreover, a number of putative growth factors, growth factor related proteins, and extracellular matrix proteins have been identified as Dkk-1 interacting proteins. Additional information regarding Dkk-1 interacting proteins identified in the Y2H assay may be obtained from publicly available databases such as PubMed via the use of the accession numbers provided in the present application. In a preferred embodiment of the invention, the amino acid sequences of these Dkk-1 interacting proteins or biologically active fragments thereof be used to modulate Dkk, Dkk-1, LRP5, LRP6, HBM, or Wnt activity. Although these proteins were identified as interacting with Dkk-1, due to the substantial homology between the various Dkk proteins, such interacting proteins are contemplated to interact with the other Dkk family members.

4. Aptamer Mimetics

The present invention further provides for mimetics of Dkk, particularly Dkk-1, and LRP5 peptide aptamers. Such aptamers may serve as structural guides to chemists for the design of mimetic compounds of the aptamers. The aptamers and their mimetics are useful as therapeutic agents to treat LRP- or Dkk-mediated diseases and conditions.

5. Nucleic Acid Molecules

The present invention further provides nucleic acid molecules that encode polypeptides and proteins which interact with Dkk and Dkk interacting proteins, and/or LRP5 (also LRP6 and HBM) to modulate biological activities of these proteins. Preferred embodiments provide nucleic acids encoding for fragments of Dkk-1 protein, including the nucleic acids of FIG. 7, the Dkk-1 interacting proteins listed in FIG. 5, polypeptide aptamers of Dkk-1 (FIG. 3—SEQ ID NOs:171-188), LRP5 (FIG. 4—SEQ ID NOs:189-192), FIG. 13 peptide aptamers (including SEQ ID NO:204-214) encoded by FIG. 12 polynucleotides (including SEQ ID NO:193-203), LRP6 and HBM and the related fusion proteins herein described, preferably in isolated or purified form. As used herein, "nucleic acid" is defined as RNA, DNA, or cDNA that encodes a peptide as defined above, or is complementary to a nucleic acid sequence encoding such peptides, or hybridizes to either the sense or antisense strands of the nucleic acid and remains stably bound to it under appropriate stringency conditions. The nucleic acid may encode a polypeptide sharing at least about 75% sequence identity, preferably at least about 80%, and more preferably at least about 85%, with the peptide sequences; at least about 90%, 95%, 96%, 97%, 98%, and 99% or greater are also contemplated. Specifically contemplated are genomic DNA, cDNA, mRNA, antisense molecules, enzymatically active nucleic acids (e.g., ribozymes), as well as nucleic acids based on an alternative backbone or including alternative bases, whether derived from natural sources or synthesized. Such hybridizing or complementary nucleic acids, however, are defined further as being novel and nonobvious over any prior art nucleic acid including that which encodes, hybridizes under appropriate stringency conditions, or is complementary to a nucleic acid encoding a protein according to the present invention.

As used herein, the terms "hybridization" (hybridizing) and "specificity" (specific for) in the context of nucleotide sequences are used interchangeably. The ability of two nucleotide sequences to hybridize to each other is based upon the degree of complementarity of the two nucleotide sequences, which in turn is based on the fraction of matched complementary nucleotide pairs. The more nucleotides in a given sequence that are complementary to another sequence, the greater the degree of hybridization of one to the other. The degree of hybridization also depends on the conditions of stringency which include temperature, solvent ratios, salt concentrations, and the like. In particular, "selective hybridization" pertains to conditions in which the degree of hybridization of a polynucleotide of the invention to its target would require complete or nearly complete complementarity. The complementarity must be sufficiently high so as to assure that the polynucleotide of the invention will bind specifically to the target nucleotide sequence relative to the binding of other nucleic acids present in the hybridization medium. With selective hybridization, complementarity will be about 90-100%, preferably about 95-100%, more preferably about 100%.

"Stringent conditions" are those that (1) employ low ionic strength and high temperature for washing, for example: 0.015 M NaCl, 0.0015 M sodium titrate, 0.1% SDS at 50° C.; or (2) employ during hybridization a denaturing agent such as formamide, for example, 50% (vol/vol) formamide with 0.1% bovine serum albumin, 0.1% Ficoll, 0.1% polyvinylpyrrolidone, 50 mM sodium phosphate buffer at pH 6.5 with 750 mM NaCl, 75 mM sodium citrate at 42° C. Another example is use of 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC and 0.1% SDS. A skilled artisan can readily determine and vary the stringency conditions appropriately to obtain a clear and detectable hybridization signal.

As used herein, a nucleic acid molecule is said to be "isolated" or "purified" when the nucleic acid molecule is substantially separated from contaminant nucleic acid encoding other polypeptides from the source of nucleic acid. Isolated or purified is also meant to include nucleic acids which encode Dkk or fragments thereof which lack surrounding genomic sequences that flank the Dkk gene. Isolated or purified is further intended to include nucleic acids which encode Dkk interacting proteins or biologically active fragments thereof which lack surrounding genomic sequences that flank the Dkk interacting protein genes.

The present invention further provides fragments of the encoding nucleic acid molecule. As used herein, a fragment of an encoding nucleic acid molecule refers to a small portion of the entire protein encoding sequence. The size of the fragment will be determined by the intended use. For example, if the fragment is chosen so as to encode an active portion of the protein, the fragment will need to be large enough to encode the functional region(s) of the protein. If the fragment is to be used as a nucleic acid probe or PCR primer, then the fragment length is chosen so as to obtain a relatively small number of false positives during probing/priming.

Fragments of the encoding nucleic acid molecules of the present invention (i.e., synthetic oligonucleotides) that are used as probes or specific primers for the polymerase chain reaction (PCR), or to synthesize gene sequences encoding proteins of the invention can easily be synthesized by chemical techniques, for example, the phosphotriester method of Matteucci et al. (*J. Am. Chem. Soc.* 103:3185-3191 (1981)) or using automated synthesis methods. In addition, larger DNA segments can readily be prepared by well known methods, such as synthesis of a group of oligonucleotides that define various modular segments of the gene, followed by ligation of oligonucleotides to build the complete modified gene.

The polypeptide encoding nucleic acid molecules of the present invention may further be modified to contain a detectable label for diagnostic and probe purposes. A variety of such labels are known in the art and can readily be employed with the encoding molecules herein described. Suitable labels include, but are not limited to, biotin, radiolabeled nucleotides and the like. A skilled artisan can employ any of the art known labels to obtain a labeled encoding nucleic acid molecule.

Modifications to the primary structure itself by deletion, addition, or alteration of the amino acids incorporated into the protein sequence during translation can be made without destroying the activity of the protein. Such substitutions or other alterations result in proteins having an amino acid sequence encoded by a nucleic acid falling within the contemplated scope of the present invention.

Antisense molecules corresponding to the polypeptide coding or complementary sequence may be prepared. Methods of making antisense molecules which bind to mRNA, form triple helices or are enzymatically active and cleave TSG RNA and single stranded DNA (ssDNA) are known in the art. See, e.g., *Antisense and Ribozyme Methodology: Laboratory Companion* (Ian Gibson, ed., Chapman & Hall, 1997) and *Ribozyme Protocols: Methods in Molecular Biology* (Phillip C. Turner, ed., Humana Press, Clifton, N.J., 1997).

Also contemplated is the use of compounds which mediate postranscriptional gene silencing (PTGS), quelling and RNA interference (RNAi). These compounds typically are about 21 to about 25 nucleotides and are also known as short interfering RNAs or short inhibitory RNAs (siRNAs). The siR- NAs are produced from an initiating double stranded RNA (dsRNA). Although the full mechanism by which the siRNAs function is not fully elucidated, it is known that these siRNAs transform the target mRNA into dsRNA, which is then degraded. Preferred forms are 5' phosphorylated siRNAs, however, hydroxylated forms may also be utilized. For additional background regarding the preparation and mechanism of siRNAs generally, see, e.g., Lipardi et al., *Cell* 107(3): 297-307 (2001); Boutla et al., *Curr. Biol.* 11(22): 1776-80 (2001); Djikeng et al., *RNA* 7(11): 1522-30 (2001); Elbashir et al., *EMBO J.* 20(23): 6877-88 (2001); Harborth et al., *J. Cell. Sci.* 114(Pt. 24): 4557-65 (2001); Hutvagner et al., *Science* 293(5531): 811-3 (2001); and Elbashir et al., *Nature* 411:494-98 (2001).

Also contemplated are short hairpin RNAs (shRNAs) shRNAs are a modification of the siRNA method described above. Instead of transfecting exogenously synthesized dsRNA into a cell, sequence-specific silencing can be achieved by stabling expressing siRNA from a DNA template as a fold-back stem-loop, or hairpin. This approach is known as shRNA. This method permits the analysis of loss of function phenotypes due to sequence-specific gene silencing in mammalian cells by avoiding many of the problems associated with siRNAs, such as RNase degradation of the reagents, expensive chemical synthesis, etc. For additional background regarding the preparation and mechanism of shRNAs generally, see, e.g., Yu et al., *PNAS* 99:6047-6052 (2002); Paddison et al., *Genes and Devel.* 16:948-58 (2002); and Brummelkamp et al., *Science* 296:550-553 (2002). For additional background on the use of this method in mammalian gene knockdown methodologies, see TuschI, *Nature Biotech.* 20:446-448 (2002) (and references therein).

In one preferred embodiment, the siRNA or shRNA is directed to a Dkk encoding mRNA, wherein a preferred Dkk is Dkk-1. In another embodiment, the siRNA or shRNA is directed towards a protein which binds to and modulates the activity of or is modulated by a Dkk; these proteins include LRP5, LRP6 and HBM as well as other members of the Wnt pathway.

6. Isolation of Other Related Nucleic Acid Molecules

The identification of the nucleic acid molecule of Dkk allows a skilled artisan to isolate nucleic acid molecules that encode other members of the Dkk family (see, Krupnik et al., 1999). Further, the presently disclosed nucleic acid molecules allow a skilled artisan to isolate nucleic acid molecules that encode. Dkk-1-like proteins, in addition to Dkk-1. The presently disclosed Dkk-1 interacting proteins and their corresponding nucleic acid molecules allows a skilled artisan to further isolate other related protein family members which interact with Dkk-1.

A skilled artisan can readily use the amino acid sequence of Dkk and Dkk interacting proteins to generate antibody probes to screen expression libraries prepared from appropriate cells. Typically, polyclonal antiserum from mammals such as rabbits immunized with the purified protein (as described below) or monoclonal antibodies can be used to probe a mammalian cDNA or genomic expression library, such as a human macrophage library, to obtain the appropriate coding sequence for other members of the protein family. The cloned cDNA sequence can be expressed as a fusion protein, expressed directly using its own control sequences, or expressed by constructions using control sequences appropriate to the particular host used for expression of the desired protein.

Alternatively, a portion of the coding sequence herein described can be synthesized and used as a probe to retrieve DNA encoding a member of the protein family from any mammalian organism. Oligomers containing approximately 18-20 nucleotides (encoding about a 6-7 amino acid stretch) are prepared and used to screen genomic DNA or cDNA libraries to obtain hybridization under stringent conditions or conditions of sufficient stringency to eliminate an undue level of false positives.

Additionally, pairs of oligonucleotide primers can be prepared for use in a polymerase chain reaction (PCR) to selectively clone an encoding nucleic acid molecule. A PCR denature/anneal/extend cycle for using such PCR primers is well known in the art and can readily be adapted for use in isolating other encoding nucleic acid molecules. For example, degenerate primers can be utilized to obtain sequences related to Dkk-1 or Dkk-1 interacting proteins. Primers can be designed that are not perfectly complementary and can still hybridize to a portion of a target sequence or flanking sequence and thereby provide for amplification of all or a portion of a target sequence. Primers of about 20 nucleotides or less, preferably have about one to three mismatches located at the 5' and/or 3' ends. Primers of about 20 to 30 nucleotides have up to about 30% mismatches and can still hybridize to a target sequence. Hybridization conditions for primers with mismatch can be determined by the method described in Maniatis et al., *Molecular Cloning: A Laboratory Manual* (Cold Spring Harbor Laboratory, Cold Spring Harbor, N.Y., 1982) or by reference to known methods. The ability of the primer to hybridize to a sequence of either Dkk-1, a Dkk-1 interacting protein, or a related sequence under varying conditions can be determined using this method. Because a target sequence is known, the effect of mismatches can be determined by methods known to those of skill in the art. Degenerate primers would be based on putative conserved amino acid sequences of the Dkk-1 and Dkk-1 interacting protein genes.

7. rDNA Molecules for Polypeptide Expression

The present invention further provides recombinant DNA molecules (rDNAs) that contain a polypeptide coding sequence. As used herein, a RDNA molecule is a DNA molecule that has been subjected to molecular manipulation in situ. Methods for generating rDNA molecules are well known in the art, for example, see Sambrook et al., *Molecular Cloning: A Laboratory Manual* (Cold Spring Harbor Laboratory, Cold Spring Harbor, N.Y., 1989). In the preferred rDNA molecules, a coding DNA sequence is operably linked to expression control sequences and/or vector sequences.

The choice of vector and/or expression control sequences to which one of the protein family encoding sequences of the present invention is operably linked depends directly, as is well known in the art, on the functional properties desired, e.g., protein expression, and the host cell to be transformed. A vector contemplated by the present invention is at least capable of directing the replication and/or insertion into the host chromosome, and preferably also expression, of the structural gene included in the rDNA molecule.

Expression control elements that are used for regulating the expression of an operably linked protein encoding sequence are known in the art and include, but are not limited to, inducible promoters, constitutive promoters, secretion signals, and other regulatory elements. Preferably, the inducible promoter is readily controlled, such as being responsive to a nutrient in the host cell's medium. Preferred promoters include yeast promoters, which include promoter regions for metallothionein, 3-phosphoglycerate kinase or other glycolytic enzymes such as enolase or glyceraldehyde-3-phosphate dehydrogenase, enzymes responsible for maltose and galactose utilization, and others. Vectors and promoters suitable for use in yeast expression are further described in EP 73,675A.

Appropriate non-native mammalian promoters might include the early and late promoters from SV40 (Fiers et al., *Nature*, 273:113 (1978)) or promoters derived from Moloney murine leukemia virus, mouse tumor virus, avian sarcoma viruses, adenovirus II, bovine papilloma virus or polyoma. In addition, the construct may be joined to an amplifiable gene (e.g., DHFR) so that multiple copies of the gene may be made. For appropriate enhancer and other expression control sequences, see also *Enhancers and Eukaryotic Gene Expression* (Cold Spring Harbor Press, Cold Spring Harbor, N.Y., 1983). Preferred bone related promoters include CMVbActin or type I collagen promoters to drive expression of the human HBM, Zmax1/LRP5 or LRP6 cDNA. Other preferred promoters for mammalian expression are from cytomegalovirus (CMV), Rous sarcoma virus (RSV), Simian virus 40 (SV40), and EF-1a (human elongation factor 1a-subunit).

In one embodiment, the vector containing a coding nucleic acid molecule will include a prokaryotic replicon, I.e., a DNA sequence having the ability to direct autonomous replication and maintenance of the recombinant DNA molecule extrachromosomally in a prokaryotic host cell, such as a bacterial host cell, transformed therewith. Such replicons are well known in the art. In addition, vectors with a prokaryotic replicon may also include a gene whose expression confers a detectable marker such as a drug resistance. Typical bacterial drug resistance genes are those that confer resistance to ampicillin or tetracycline.

Vectors that include a prokaryotic replicon can further include a prokaryotic or bacteriophage promoter capable of directing the expression (transcription and translation) of the coding gene sequences in a bacterial host cell, such as *E. coli*. A promoter is an expression control element formed by a DNA sequence that permits binding of RNA polymerase and transcription to occur. Promoter sequences compatible with bacterial hosts are typically provided in plasmid vectors containing convenient restriction sites for insertion of a DNA segment of the present invention. Typical of such vector plasmids are pUC8, pUC9, pBR322 and pBR329 available from Biorad Laboratories, (Richmond, Calif.), and pPL and pKK223 available from Pharmacia (Piscataway, N.J.).

Expression vectors compatible with eukaryotic cells, preferably those compatible with vertebrate cells, can also be used to form a rDNA molecule that contains a coding sequence. Eukaryotic cell expression vectors are well known in the art and are available from several commercial sources. Typically, such vectors are provided containing convenient restriction sites for insertion of a desired DNA segment. Typical of such vectors are pSVL and pKSV-10 (Pharmacia), pBPV-1/pML2d (International Biotechnologies, Inc.), vector systems that include Histidine Tags and periplasmic secretion, or other vectors described in the art.

Eukaryotic cell expression vectors used to construct the rDNA molecules of the present invention may further include a selectable marker that is effective in an eukaryotic cell, preferably a drug resistance selection marker. A preferred drug resistance marker is the gene whose expression results in neomycin resistance, i.e., the neomycin phosphotransferase (neo) gene (Southern et al., *J. Mol. Anal. Genet.* 1:327-341 (1982)). Alternatively, the selectable marker can be present on a separate plasmid, and the two vectors introduced by co-transfection of the host cell, and selected by culturing in the appropriate drug for the selectable marker.

8. Host Cells Containing an Exogenously Supplied rDNA Nucleic Acid Molecule

The present invention further provides host cells transformed with a nucleic acid molecule that encodes a polypeptide or protein of the present invention. The host cell can be either prokaryotic or eukaryotic. Eukaryotic cells useful for expression of a protein of the invention are not limited, so long as the cell line is compatible with cell culture methods and compatible with the propagation of the expression vector and expression of the gene product. Preferred eukaryotic host cells include, but are not limited to, yeast, insect and mammalian cells, preferably vertebrate cells such as those from a mouse, rat, monkey or human cell line but also can include invertebrates with, for example, cartilage. Preferred eukaryotic host cells include but are not limited to Chinese hamster ovary (CHO) cells (ATCC No. CCL61), NIH Swiss mouse embryo cells NIH/3T3 (ATCC No. CRL 1658), baby hamster kidney cells (BHK), HOB-03-CE6 osteoblast cells, and other like eukaryotic tissue culture cell lines.

Any prokaryotic host can be used to express a rDNA molecule encoding a protein of the invention. A preferred prokaryotic host is *E. coli*.

Transformation of appropriate cell hosts with a recombinant DNA (rDNA) molecule of the present invention is accomplished by well known methods that typically depend on the type of vector used and host system employed. With regard to transformation of prokaryotic host cells, electroporation and salt treatment methods are typically employed; see, for example, Cohen et al., *Proc. Natl. Acad. Sci USA* 69: 2110 (1972); Maniatis et al. (1982); and Sambrook et al. (1989). With regard to transformation of vertebrate cells with vectors containing rDNAs, electroporation, cationic lipid or salt treatment methods are typically employed; see, for example, Graham et al., *Virol.* 52: 456 (1973); Wigler et al., *Proc. Natl. Acad. Sci. USA* 76: 1373-76 (1979).

Successfully transformed cells, i.e., cells that contain a rDNA molecule of the present invention, can be identified by well known techniques including the selection for a selectable marker. For example, cells resulting from the introduction of an rDNA of the present invention can be cloned to produce single colonies. Cells from those colonies can be harvested, lysed and their DNA content examined for the presence of the rDNA using a method such as that described by Southern, *J. Mol. Biol.* 98: 503 (1975), or Berent et al., *Biotech.* 3: 208 (1985). Alternatively, the cells can be cultured to produce the proteins encoded by the rDNA and the proteins harvested and assayed, using for example, any suitable immunological method. See, e.g., Harlow et al., (1988).

Recombinant DNA can also be utilized to analyze the function of coding and non-coding sequences. Sequences that modulate the translation of the mRNA can be utilized in an affinity matrix system to purify proteins obtained from cell lysates that associate with the Dkk-1 or Dkk-1 interacting protein or expression control sequence. Synthetic oligonucleotides would be coupled to the beads and probed with the lysates, as is commonly known in the art. Associated proteins could then be separated using, for example, a two dimensional SDS-PAGE system. Proteins thus isolated could be further identified using mass spectroscopy or protein sequencing. Additional methods would be apparent to the skilled artisan.

9. Production of Recombinant Peptides and Proteins using a cDNA or Other Recombinant Nucleic Acids The invention also relates to nucleic acid molecules which encode a Dkk protein and polypeptide fragments thereof, and proteins and polypeptides which bind to Dkk (e.g., LRP5 LRP6 and HBM, Dkk interacting proteins suchaproteins of FIG. 5) and molecular analogues. The polypeptides of the present invention include the full length Dkk and polypeptide fragments thereof, Dkk binding proteins and polypeptides thereof. Preferably these proteins are mammalian proteins, and most preferably human proteins and biologically active fragments thereof. Alternative embodiments include nucleic acid molecules encoding polypeptide fragments having a consecutive amino acid sequence of at least about 3, 5, 7, 8, 9, 10, 15, 20, 25, 30, 40, 50, 60, 70, 80, 90, 100, 125, 150, 175, or 200 amino acid residues from a common polypeptide sequence; amino acid sequence variants of a common polypeptide sequence wherein an amino acid residue has been inserted N- or C-terminal to, or within, the polypeptide sequence or its fragments; and amino acid sequence variants of the common polypeptide sequence or its fragments, which have been substituted by another conserved residue. Recombinant nucleic acid molecules which encode polypeptides include those containing predetermined mutations by, e.g., homologous recombination, site-directed or PCR mutagenesis, and recombinant Dkk proteins or polypeptide fragments of other animal species, including but not limited to vertebrates (e.g., rabbit, rat, murine, porcine, camelid, reptilian, daprine, avian, fish, bovine, ovine, equine and non-human primate species) as well as invertebrates, and alleles or other naturally occurring variants and homologs of Dkk binding proteins of the foregoing species and of human sequences. Also contemplated herein are derivatives of the commonly known Dkk, Dkk interacting proteins, or fragments thereof, wherein Dkk, Dkk interacting proteins, or their fragments have been covalently modified by substitution, chemical, enzymatic, or other appropriate means with a moiety other than a naturally occurring amino acid (for example a detectable moiety such as an enzyme or radioisotope) and soluble forms of Dkk. It is further contemplated that the present invention also includes nucleic acids with silent mutations which will hybridize to the endogenous sequence and which will still encode the same polypeptide.

The nucleic acid molecules encoding Dkk binding proteins, the LRP5 binding domain fragment of Dkk, or other polypeptides of the present invention are preferably those which share a common biological activity (e.g., mediate Dkk activity such as its interaction with LRP5, HBM or LRP6). The polypepties of the present invention include those encoded by a nucleic acid molecule with silent mutations, as well as those nucleic acids encoding a biologically active protein with conservative amino acid substitutions, allelic variants, and other variants of the disclosed polypeptides which maintain at least one Dkk activity.

The amino acid compounds of the invention are polypeptides which are partially defined in terms of amino acid residues of designated classes. Polypeptide homologs would include conservative amino acid substitutions within the amino acid classes described below. Amino acid residues can be generally sub-classified into four major subclasses as follows:

Acidic: The residue has a negative charge due to loss of $H^+$ ion at physiological pH, and the residue is attracted by aqueous solution so as to seek the surface positions in the conformation of a peptide in which it is contained when the peptide is in aqueous medium, at physiological pH.

Basic: The residue has a positive charge due to association with $H^+$ ion at physiological pH, and the residue is attracted by aqueous solution so as to seek the surface positions in the conformation of a peptide in which it is contained when the peptide is in aqueous medium at physiological pH.

Neutral/non-polar: The residues are not charged at physiological pH, but the residue is repelled by aqueous solution so as to seek the inner positions in the conformation of a peptide in which it is contained when the peptide is in aqueous medium. These residues are also designated "hydrophobic."

Neutral/polar: The residues are not charged at physiological pH, but the residue is attracted by aqueous solution so as to seek the outer positions in the conformation of a peptide in which it is contained when the peptide is in aqueous medium.

It is understood, of course, that in a statistical collection of individual residue molecules some molecules will be charged, and some not, and there will be an attraction for or repulsion from an aqueous medium to a greater or lesser extent. To fit the definition of "charged", a significant percentage (at least approximately 25%) of the individual molecules are charged at physiological pH. The degree of attraction or repulsion required for classification as polar or nonpolar is arbitrary and, therefore, amino acids specifically contemplated by the invention have been classified as one or the other. Most amino acids not specifically named can be classified on the basis of known behavior.

Amino acid residues can be further subclassified as cyclic or noncyclic, and aromatic or non-aromatic, self-explanatory classifications with respect to the side chain substituent groups of the residues, and as small or large. The residue is considered small if it contains a total of 4 carbon atoms or less, inclusive of the carboxyl carbon. Small residues are, of course, always nonaromatic.

The gene-encoded secondary amino acid proline, although technically within the group neutral/nonpolar/large/cyclic and nonaromatic, is a special case due to its known effects on the secondary conformation of peptide chains, and is not, therefore, included in this defined group.

Other amino acid substitutions of those encoded in the gene can also be included in peptide compounds within the scope of the invention and can be classified within this general scheme according to their structure.

All of the compounds of the invention may be in the form of the pharmaceutically acceptable salts or esters. Salts may be, for example, $Na^+$, $K^+$, $Ca^{+2}$, $Mg^{+2}$ and the like; the esters are generally those of alcohols of 1-6 carbons.

The present invention further provides methods for producing a protein of the invention using nucleic acid molecules herein described. In general terms, the production of a recombinant form of a protein typically involves the following steps.

First, a nucleic acid molecule is obtained that encodes Dkk, such as a nucleic acid molecule encoding human Dkk or any other Dkk sequence, or that encodes a Dkk binding protein, a Dkk aptamer or a biologically active fragment thereof. Particularly for Dkk binding peptides, the nucleotides encoding the peptide are incorporated into a nucleic acid in the form of an in-frame fusion, insertion into or appended to a thioredoxin coding sequence. The coding sequence (ORF) is directly suitable for expression in any host, as it is not interrupted by introns.

These DNAs can be transfected into host cells such as eukaryotic cells or prokaryotic cells. Eukaryotic hosts include mammalian cells and vertebrate (e.g., osteoblasts, osteosarcoma cell lines, *Drosophila* S2 cells, hepatocytes, tumor cell lines and other bone cells of any mammal, as well as insect cells, such as Sf9 cells using recombinant baculovirus). For example, a DNA expressing an open reading frame (ORF) under control of a type I collagen promoter, or such osteoblast promoters as osteocalcin histone, type I collagen, TGFβ1, MSX2, cfos/cJun and Cbfa1, can be used to regulate the Dkk in animal cells. Alternatively, the nucleic acid can be placed downstream from an inducible promoter, which can then be placed into vertebrate or invertebrate cells or be used in creating a transgenic animal model.

Alternatively, proteins and polypeptides of the present invention can be expressed in an heterologous system. The human cell line GM637, SV-40 transformed human fibroblasts, can be transfected, with a plasmid containing a Dkk ligand binding domain coding sequence under the control of the chicken actin promoter (Reis et al., *EMBO J.* 11: 185-193 (1992)). Such transfected cells could be used as a source of Dkk binding domain in functional assays. Alternatively, polypeptides encoding only a portion of Dkk or any of the disclosed Dkk binding peptides Dkk aptamers or a polypeptide encoding a Dkk interacting protein can be expressed alone or in the form of a fusion protein. For example, Dkk derived peptides can be expressed in bacteria (e.g., *E. coli*) as GST- or His-Tag fusion proteins. These fusion proteins are then purified and can be used to generate polyclonal antibodies or can be used to identify other Dkk ligands.

The nucleic acid coding sequence is preferably placed in operable linkage with suitable control sequences, as described above, to form an expression unit containing the protein encoding open reading frame. The expression unit is used to transform a suitable host and the transformed host is cultured under conditions that allow the production of the recombinant protein. Optionally the recombinant protein is isolated from the medium or from the cells; recovery and purification of the protein may not be necessary in some instances where some impurities may be tolerated.

Each of the foregoing steps can be done in a variety of ways. For example, the desired coding sequences may be obtained from genomic fragments and used directly in appropriate hosts. The construction of expression vectors that are operable in a variety of hosts is accomplished using appropriate replicons and control sequences, as set forth above. The control sequences, expression vectors, and transformation methods are dependent on the type of host cell used to express the gene and were discussed in detail earlier. Suitable restriction sites can, if not normally available, be added to the ends of the coding sequence so as to provide an excisable gene to insert into these vectors. A skilled artisan can readily adapt any host/expression system known in the art for use with the nucleic acid molecules of the invention to produce recombinant protein.

10. Methods to Identify Binding Partners

Another embodiment of the present invention provides methods for use in isolating and identifying binding partners of Dkk or Dkk interacting proteins. Dkk or a Dkk interacting protein or a polypeptide fragment thereof can be mixed with a potential binding partner or an extract or fraction of a cell under conditions that allow the association of potential binding partners with Dkk or with Dkk interacting proteins. After mixing, the peptides, polypeptides, proteins or other molecules that have become associated with Dkk or a Dkk interacting protein are separated from the mixture. The binding partner that bound to the polypeptide then can be purified and further analyzed. Determination of binding partners of Dkk and Dkk interacting proteins as well as agents which prevent the interaction of Dkk with one of its interacting proteins (e.g., LRP5, LRP6, HBM, or those proteins listed in FIG. 5) can be performed using a variety of different competition assays as are known in the art. For example, the minimal sequence of Dkk, as described herein, can be used to identify antibodies which compete with LRP5 (or LRP6, HBM or other ligand binding partners) for binding to Dkk-1 and vice versa. The minimal Dkk sequence can be bound to the bottom of a 96-well plate (or other solid substrate), and antibodies or other potential binding agents (e.g., polypeptides, mimetics, homologs, antibody fragments and the like) can be screened in a competition assay to identify agents with binding affinities, for example, greater than the natural ligand binding partner of Dkk.

In the present invention, suitable cells are used for preparing assays, for the expression of a LRP and/or Dkk or proteins that interact therewith. The cells may be made or derived from mammals, yeast, fungi, or viruses. A suitable cell for the purposes of this invention is one that includes but is not limited to a cell that can exhibit a detectable Dkk-LRP (or HBM) interaction, and preferably, the differential interaction between Dkk-1-LRP5 and Dkk-1-HBM. For the desired assay, the cell type may vary. In several embodiments, bone cells are preferred, for example, a human osteoblast cell (e.g. hOB-03-CE6) or osteosarcoma cell (e.g. U20S). Additional hOB cells are hOB-03-C5, hOB-02-02 and, an immortalized pre-osteocytic cell line referred to as hOB-01-C1-PS-09 cells (which are deposited with American Type Culture Collection in Manassas, Va. with the designation PTA-785), Examples of osteosarcoma cells would include SaoS2, MG63 and HOS TE85 Immortalized refers to a substantially continuous and permanently established cell culture with substantially unlimited cell division potential. That is, the cells can be cultured substantially indefinitely, i.e., for at least about 6 months under rapid conditions of growth, preferably much longer under slower growth conditions, and can be propagated rapidly and continually using routine cell culture techniques. Alternatively stated, preferred cells can be cultured for at least about 100, 150 or 200 population doublings. These cells produce a complement of proteins characteristic of normal human osteoblastic cells and are capable of osteoblastic differentiation. They can be used in cell culture studies of osteoblastic cell sensitivity to various agents, such as hormones, cytokines, and growth factors, or in tissue therapy. Certain non bone cells such as HEK 293 cells that exhibit detectable Dkk-LRP (or HBM) interaction are also be useful for the assays of this invention.

To identify and isolate a binding partner, the entire Dkk protein (e.g., human Dkk-1, GenBank Accession No. BAA34651) or a Dkk interacting protein (Genbank Accession Nos for some Dkk-1 interacting proteins are given in FIG. 5) can be used. Alternatively, a polypeptide fragment of the protein can be used. Suitable fragments of the protein include, at least about 5, 6, 7, 8, 9, 10, 15, 20, 25, 30, 35, 40, 45, 50, 55, 60, 65, 70, 75, 80, 85, 90, 95, 100, 110, 120, 130, 140, 150 or more contiguous amino acid residues of any Dkk or Dkk interactor sequence. Preferable sequences of Dkk include portions or all of one or both of the cysteine rich domains (e.g., Cys-1 and Cys-2 of Dkk-1) or the conserved sequences at the amino terminus of Dkk-1 (See Krupnik et al., *Gene* 238: 301-313 (1999)). Alternatively, portions of LRP5, LRP6, HBM and other Dkk interacting proteins such as those in FIG. 5 that interact with Dkk-1 can be used to identify and isolate agents which modulate Dkk activity. Alternatively, peptide aptamers of LRP5, LRP6, HBM, Dkk and other Dkk interacting proteins such as those in FIG. 5 that interact with Dkk-1 can be used to identify and isolate agents which modulate Dkk activity.

As used herein, a cellular extract refers to a preparation or fraction which is made from a lysed or disrupted cell. A variety of methods can be used to obtain cell extracts. Cells can be disrupted using either physical or chemical disruption methods. Examples of physical disruption methods include, but are not limited to, sonication and mechanical shearing. Examples of chemical lysis methods include, but are not limited to, detergent lysis and enzyme lysis. A skilled artisan can readily adapt methods for preparing cellular extracts in order to obtain extracts for use in the present methods.

Once an extract of a cell is prepared, the extract is mixed with the protein of the invention under conditions in which association of the protein with the binding partner can occur. A variety of conditions can be used, the most preferred being conditions that closely resemble conditions found in the cytoplasm of a human cell. Features such as osmolarity, pH, temperature, and the concentration of cellular extract used, can be varied to optimize the association of the protein with the binding partner.

After mixing under appropriate conditions, the bound complex is separated from the mixture. A variety of techniques can be utilized to separate the mixture. For example, antibodies specific to a protein of the invention can be used to immunoprecipitate the binding partner complex. Alternatively, standard chemical separation techniques such as chromatography and density/sediment centrifugation can be used. For example, a protein of the invention is expressed with an affinity tag such as a His tag. The His labeled protein and any bound molecule may be retained and selectively eluted from a Ni-NTA column.

After removal of no-associated cellular constituents found in the extract, the binding partner can be dissociated from the complex using conventional methods. For example, dissociation can be accomplished by altering the salt concentration or pH of the mixture.

To aid in separating associated binding partner pairs from the mixed extract, the protein of the invention can be immobilized on a solid support. For example, the protein can be attached to a nitrocellulose matrix or acrylic beads. Attachment of the protein to a solid support aids in separating peptide/binding partner pairs from other constituents found in the extract. The identified binding partners can be either a single protein or a complex made up of two or more proteins.

Alternatively, the nucleic acid molecules of the invention can be used in a Y2H system. The Y2H system has been used to identify other protein partner pairs and can readily be adapted to employ the nucleic acid molecules herein described. Methods of performing and using Y2H systems are known. See, e.g., Finley et al., "Two-Hybrid Analysis of Genetic Regulatory Networks," in *The Yeast Two-Hybrid System* (Paul L. Bartel et al., eds., Oxford, 1997); Meijia Yang, "Use of a Combinatorial Peptide Library in the Two-Hybrid Assay," in *The Yeast Two-Hybrid System* (Paul L. Bartel et al., eds., Oxford, 1997); Gietz et al., "Identification of proteins that interact with a protein of interest: Applications of the yeast two-hybrid system," *Mol. & Cell. Biochem.* 172: 67-9 (1997); K. H. Young, "Yeast Two-Hybrid: So Many Interactions,(in) so Little Time," *Biol. Reprod.* 58: 302-311 (1998); R. Brent et al., "Understanding Gene and Allele Function with Two-Hybrid Methods," *Annu. Rev. Genet.* 31:663-704 (1997) and U.S. Pat. No. 5,989,808. The Dkk-1 interacting proteins identified in FIG. 5 were identified using the Y2H interacting system using Dkk-1 as bait.

One preferred in vitro binding assay for Dkk modulators would comprise a mixture of a LRP binding domain of Dkk and one or more candidate binding targets or substrates. After incubating the mixture under appropriate conditions, one would determine whether Dkk or a fragment thereof bound with the candidate modulator present. For cell-free binding assays, one or more of the components usually comprises or is coupled to a label. The label may provide for direct detection, such as radioactivity, luminescence, optical or electron density, etc., or indirect detection such as an epitope tag, an enzyme, etc. A variety of methods may be employed to detect the label depending on the nature of the label and other assay components. For example, the label may be detected bound to the solid substrate or a portion of the bound complex containing the label may be separated from the solid substrate, and the label thereafter detected. Fluorescence resonance energy transfer may be utilized to monitor the interaction of two labeled molecules. For example, a fluorescence label on Dkk and another label on LRP5 or a soluble fragment thereof such as the extracellular domain will exchange fluorescence resonance energy when in close proximity indicating that the two molecules are bound. A preferred binding partner for Dkk will increase or decrease the affinity between Dkk and LRP5 which will be readily observable in a fluorescence spectrometer. Alternatively, an instrument, such as a surface plasmon resonance detector manufactured by BIAcore (Uppsala, Sweden), may be used to observe interactions with a fixed target. One skilled in the art knows of many other methods which may be employed for this purpose.

Thereby, the present invention provides methods for screening candidates including polypeptides of the present invention for activity which identifies these candidates as valuable drug leads. Other suitable methods are also known in the art and are suitable for use herein, including *Xenopus* oocyte injection studies and TCF luciferase assays.

Additional assays can be used to identify the activity of Dkk and Dkk interacting proteins in the Wnt pathway, as well as the impact of modulators of Dkk and Dkk interacting proteins on the Wnt pathway. These include, for example, a *Xenopus* embryo assay and a TCF-luciferase reporter gene assay to monitor Wnt signaling modulation.

*Xenopus* embryos are an informative in vivo assay system to evaluate the modulation of Wnt signaling. Ectopic expression of certain Wnts or other activators of the Wnt signaling pathway results in a bifurcation of the anterior neural plate. This bifurcation results in a duplicated body axis, which suggests a role for Wnt signaling during embryonic development (McMahon et al., *Cell* 58: 1075-84 (1989); Sokol et al., *Cell* 67:741-52(1991)). Since these original observations, the *Xenopus* embryo assay has been extensively used as an assay system for evaluating modulation of the Wnt signaling pathway. One preferred embodiment of the present invention is demonstrated in Example 6.

Constructs for *Xenopus* expression can be prepared as would be known in the art. For example, a variety of cDNAs have been engineered into the vector pCS2+ (Turner et al., *Genes Devel.* 8: 1434-1447 (1994)) to facilitate the in vitro generation of mRNA for use in *Xenopus* embryo injection experiments. DNA inserts are subcloned in the sense orientation with respect to the vector SP6 promoter. Downstream of the insert, the vector provides an SV40 virus polyadenylation signal and a T3 promoter sequence (i.e., for the generation of antisense mRNA). Constructs can be generated for various Dkk family members, LRP5, LRP6, HBM, Dkk-1 interactors, etc. Constructs could be generated in pCS2$^+$ that contain the nucleic acid sequence encoding for the peptide aptamers that were identified in yeast screens. These sequences would be fused to a 5' synthetic translation initiation sequence followed by a canonical signal sequence to ensure that the peptide aptamer would be translated and secreted from the cell.

Once these constructs are made then mRNA can be synthesized and injected into *Xenopus* oocytes mRNA for microinjection into *Xenopus* embryos is generated by in vitro transcription using the cDNA constructs in the pCS2$^+$ vector described above as template. Various amounts of RNA can be injected into the ventral blastomere of the 4-or 8-cell *Xenopus* embryo substantially as described in Moon et al., *Technique-J. of Methods in Cell and Mol. Biol.* 1: 76-89 (1989), and Peng, *Meth. Cell. Biol.* 36: 657-62 (1991).

Previous data has shown that expression of LRP5, in the presence of Wnt5a, results in a Wnt-induced duplicated axis formation in *Xenopus* embryos (Tamai et al., *Nature* 407: 530-535 (2000)). The roles of Dkk-1 and Dkk-2, and Dkk-1 interacting proteins, in modulating the LRP5-mediated Wnt response in vivo can be analyzed using, for example, the *Xenopus* embryo. In addition, the peptide aptamers, Dkk interacting proteins, or combinations of the above can be evaluated in a similar manner.

Experiments can also be conducted wherein RNA is injected into the dorsal blastomere to ensure the specificity of the observed phenotypes. Lineage tracing experiments can be performed where a marker gene such as green fluorescent protein (GFP) or LacZ is co-injected with the experimental RNAs. Detecting marker gene expression would identify the targeted cells of the microinjection and aid in elucidating the mechanism of action. In addition to the Wnt signaling components listed above, the point at which HBM acts upon the Wnt pathway can also be analyzed. This can be done by co-injections of various dominant-negative constructs. For example, a dominant negative TCF-3 construct would be useful to demonstrate that the observed axis duplication (and Wnt activation) is mediated via the β-catenin-TCF response. If so, such a construct would be expected to abolish the observed duplicated axis phenotype.

Another example would include a dominant negative Dsh construct. Since Dsh is far upstream in the Wnt signaling pathway, a dominant negative construct should abolish the activation of the Wnt response and the observed axis duplication. If it does not, this would suggest that axis duplication is being induced via a different signaling pathway.

The marker genes of the injected *Xenopus* embryos can be analyzed as follows. Representative embryos are collected at stage 10.5 (11 hours post fertilization) for marker gene analysis. RNA is extracted and purified from the embryos following standard protocols (Sambrook et al., 1989 at 7.16). Marker genes could include the following: Siamois (i.e., Wnt responsive gene), Xnr3 (i.e., Wnt responsive gene), slug (i.e., neural crest marker), Xbra (i.e., early mesoderm marker), HNK-1 (i.e., ectodermal/neural marker), endodermin (i.e., endoderm), Xlhbox8 (i.e., pancreatic), BMP2 and BMP4 (i.e., early mesoderm), XLRP6 (i.e., maternal and zygotic expression, it is also the LRP6 homolog in the frog), EF-1 (i.e., control) and ODC (i.e., control). Induction of marker genes is analyzed and quantitated by RT-PCR/TaqMan®.

This type of marker analysis is excellent to monitor changes in gene expression that result very early in the embryo as a direct result of signaling perturbation. Other experiments could be designed that would monitor changes in gene expression in a more tissue or spatially-restricted fashion. Examples would include the generation of a transgenic *Xenopus* mode. For example, Zmax/LRP5 and HBM expression could be under the control of the brachyury or cardiac-actin promoters directing gene expression transiently in the mesoderm or in the somites, respectively. Phenotype analyses of these transgenic *Xenopus* animals would include marker gene analysis/transcriptional profiling (from a restricted tissue source) and histologic examination of the tissue.

A TCF-luciferase assay system such as that described in Example 7 can also be used to monitor Wnt signaling activity, Dkk activity and Dkk interacting protein activity.

Constructs for the TCF-luciferase assays can be prepared as would be known in the art. For example, Dkk and Dkk interacting protein peptides, LRP5/LRP6, among others, can be expressed in pcDNA3.1, using Kozak and signal sequences to target peptides for secretion.

Once constructs have been prepared, cells such as osteoblasts and HEK293 cells are seeded in well plates and transfected with construct DNA, CMV beta-galactosidase plasmid DNA, and TCF-luciferase reporter DNA. The cells are then lysed and assayed for beta-galactosidase and luciferase activity to determine whether Dkk, Dkk interacting proteins, or other molecules such as antibodies affect Wnt signaling.

Additional assays for monitoring Wnt signaling activity, Dkk activity, and Dkk interacting protein activity include:

Modulation of another Wnt-responsive transcription factor, LEF, as visualized by a reporter gene activity. One example includes the activation of the LEF1 promoter region fused to the luciferase reporter gene (Hsu et al., *Mol. Cell. Biol.* 18: 4807-18 (1999)).

Alterations in cell proliferation, cell cycle or apoptosis. There are numerous examples describing Wnt-mediated cellular transformations including Shimizu et al., *Cell. Growth Differ.* 8: 1349-58 (1997).

Stabilization and cellular localization of de-phosphorylated β-catenin as an indicator of Wnt activation (Shimizu et al., 1997).

Additional methods of assaying Wnt signaling, through either the canonical or non-canonical pathways, would be apparent to the artisan of ordinary skill.

11. Methods to Identify Agents that Modulate the Expression of a Nucleic Acid Encoding the Dkk and/or LRP5 Proteins and/or Dkk Interacting Proteins Another embodiment of the present invention provides methods for identifying agents that modulate the expression of a nucleic acid encoding Dkk. Such assays may utilize any available means of monitoring for changes in the expression level of the nucleic acids of the invention. As used herein, an agent is said to modulate the expression of Dkk, if it is capable of up- or down-regulating expression of the nucleic acid in a cell (e.g., mRNA).

In one assay format, cell lines that contain reporter gene fusions between the nucleic acid encoding Dkk (or proteins which modulate the activity of Dkk) and any assayable fusion partner may be prepared. Numerous assayable fusion partners are known and readily available, including but not limited to the firefly luciferase gene and the gene encoding chloramphenicol acetyltransferase (Alam et al., *Anal. Biochem.* 188: 245-254 (1990)). Cell lines containing the reporter gene fusions are then exposed to the agent to be tested under appropriate conditions and time. Differential expression of the reporter gene between samples exposed to the agent and control samples identifies agents which modulate the expression of a nucleic acid encoding Dkk or other protein which modulates Dkk activity. Such assays can similarly be used to determine whether LRP5 and even LRP6 activity is modulated by regulating Dkk activity.

Additional assay formats may be used to monitor the ability of the agent(s) to modulate the expression of a nucleic acid encoding Dkk, alone or Dkk and LRP5, and/or Dkk interacting proteins such as those identified in FIG. 5. For instance, mRNA expression may be monitored directly by hybridization to the nucleic acids of the invention. Cell lines are exposed to the agent to be tested under appropriate conditions and time and total RNA or mRNA is isolated by standard procedures such those disclosed in Sambrook et al. (1989); Ausubel et al., *Current Protocols in Molecular Biology* (Greene Publishing Co., NY, 1995); Maniatis et al., *Molecular Cloning: A Laboratory Manual* (Cold Spring Harbor Laboratory, Cold Spring Harbor, N.Y., 1982); and *Short Pro-* tocols in Molecular Biology: A Compendium of Methods from Current Protocols in Molecular Biology (Frederick M. Ausubel et al., April 1999).

Probes to detect differences in RNA expression levels between cells exposed to the agent and control cells may be prepared from the nucleic acids of the invention. It is preferable, but not necessary, to design probes which hybridize only with target nucleic acids under conditions of high stringency. Only highly complementary nucleic acid hybrids form under conditions of high stringency. Accordingly, the stringency of the assay conditions determines the amount of complementarity which should exist between two nucleic acid strands in order to form a hybrid. Stringency should be chosen to maximize the difference in stability between the probe:target hybrid and potential probe:non-target hybrids.

Probes may be designed from the nucleic acids of the invention through methods known in the art. For instance, the G+C content of the probe and the probe length can affect probe binding to its target sequence. Methods to optimize probe specificity are commonly available. See for example, Sambrook et al. (1989) or Ausubel et al. (*Current Protocols in Molecular Biology*, Greene Publishing Co., NY, 1995).

Hybridization conditions are modified using known methods, such as those described by Sambrook et al. (1989) and Ausubel et al. (1995), as suitable for each probe. Hybridization of total cellular RNA or RNA enriched for polyA RNA can be accomplished in any available format. For instance, total cellular RNA or RNA enriched for polyA RNA can be affixed to a solid support and the solid support exposed to at least one probe comprising at least one, or part of one of the nucleic acid sequences of the invention under conditions in which the probe will specifically hybridize. Alternatively, nucleic acid fragments comprising at least one, or part of one of the sequences of the invention can be affixed to a solid support, such as a porous glass wafer. The glass or silica wafer can then be exposed to total cellular RNA or polyA RNA from a sample under conditions in which the affixed sequences will specifically hybridize. Such glass wafers and hybridization methods are widely available, for example, those disclosed by Beattie (WO 95/11755). By examining for the ability of a given probe to specifically hybridize to an RNA sample from an untreated cell population and from a cell population exposed to the agent, agents which up- or down-regulate the expression of a nucleic acid encoding Dkk, a Dkk interacting protein, and/or LRP5 can be identified.

Microarray technology and transcriptional profiling are examples of methods which can be used to analyze the impact of putative Dkk or Dkk interacting protein modulating compounds. For transcriptional profiling, mRNA from cells exposed in vivo to a potential Dkk modulating agent, such as the Dkk interacting proteins identified in the present invention (e.g., those identified in FIG. 5), agents which modulate Dkk interacting proteins, and mRNA from the same type of cells that were not exposed to the agent could be reverse transcribed and hybridized to a chip containing DNA from numerous genes, to thereby compare the expression of genes in cells treated and not treated with the agent. If, for example a putative Dkk modulating agent down-regulates the expression of Dkk in the cells, then use of the agent may be undesirable in certain patient populations. For additional methods of transcriptional profiling and the use of microarrays, refer to, for example, U.S. Pat. No. 6,124,120 issued to Lizardi (2000).

Additional methods for screening the impact of Dkk and Dkk interacting protein modulating compounds or the impact of Dkk or Dkk interacting proteins on modulation of LRP5, LRP6, HBM or the Wnt pathway include the use of TaqMan PCR, conventional reverse transcriptase PCR (RT-PCR), changes in downstream surrogate markers (i.e., Wnt responsive genes), and anti-Dkk Western blots for protein detection. Other methods would be readily apparent to the artisan of ordinary skill.

12Methods to Identify Agents that Modulate at Least One Activity of Dkk, a Dkk Interacting Protein, or LRP5/LRP6/HBM Another embodiment of the present invention provides methods for identifying agents that modulate at least one activity of Dkk, Dkk interacting proteins, and/or LRP5/LRP6/HBM proteins or preferably which specifically modulate an activity of a Dkk/Dkk interacting protein complex or an LRP5(or LRP6/HBM)/Dkk complex, or a biologically active fragment of Dkk (e.g., comprising the domain which binds LRP5/LRP6/HBM) or a Dkk interacting protein complex. Such methods or assays may utilize any means of monitoring or detecting the desired activity as would be known in the art (See, e.g., Wu et al., *Curr. Biol.* 10:1611-4 (2000); Fedi et al., *J. Biol. Chem.* 274:19465-72 (1991); Grotewold et al., *Mech. Dev.* 89:151-3 (1999); Shibata et al., *Mech. Dev.* 96:243-6 (2000); Wang et al., *Oncogene* 19:1843-8 (2000); and Glinka et al., *Nature* 391:357-62 (1998)). Potential agents which modulate Dkk include, for example, p53, the tumor suppressor protein, which can induce Dkk-1. Damage to DNA has also been observed to up-regulate Dkk-1 expression via a stabilization and activation of p53 (Wang et al., *Oncogene* 19:1843-48 (2000)); and, Shou et al., *Oncogene* 21:878-89 (2002)). Additionally, Fedi et al. (1999) purportedly showed that Dkk-1 can block the Wnt2-induced oncogenic transformation of NIH-3T3 cells. Furthermore, it has been suggested that Dkk expression can be modulated by BMP signaling in the developing skeleton (Mukhopadhyay et al., *Dev, Cell.* 1:423-34 (2001); and Grotewold et al., *EMBO J.* 21: 966-75 (2002)). Grotewold et al. additionally describe altered Dkk expression levels in response to stress signals including UV irradiation and other genotoxic stimuli. They propose that Dkk expression is pro apoptotic. In animals expressing HBM constructs conferring high bone mass, a reduced osteoblast apoptosis effect was observed. Thus, HBM and HBM-like variants may control/alter Dkk's role in programmed cell death. Other agents which potentially modulate Dkk activity include the Dkk interacting proteins identified in FIG. 5.

In one embodiment, the relative amounts of Dkk or a Dkk interacting protein of a cell population that has been exposed to the agent to be tested is compared to an un-exposed control cell population. Antibodies can be used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, as would be known in the art. See, e.g., Ed Harlow and David Lane, *Antibodies: A Laboratory Manual* (Cold Spring Harbor, N.Y., 1988) and Ed Harlow and David Lane, *Using Antibodies: A Laboratory Manual* (Cold Spring Harbor, N.Y. 1998).

For example, N- and C-terminal fragments of Dkk can be expressed in bacteria and used to search for proteins which bind to these fragments. Fusion proteins, such as His-tag or GST fusion to the N- or C-terminal regions of Dkk (or to biologically active domains of Dkk-1) or a whole Dkk protein can be prepared. These fusion proteins can be coupled to, for example, Talon or Glutathione-Sepharose beads and then probed with cell lysates to identify molecules which bind to Dkk. Prior to lysis, the cells may be treated with purified Wnt proteins, RNA, or drugs which may modulate Wnt signaling or proteins that interact with downstream elements of the Wnt pathway. Lysate proteins binding to the fusion proteins can be resolved by SDS-PAGE, isolated and identified by, for example protein sequencing or mass spectroscopy, as is known in the art. See, e.g., *Protein Purification Applications: A Practical Approach* (Simon Roe, ed., 2$^{nd}$ ed. Oxford Univ. Press, 2001) and "Guide to Protein Purification" in *Meth. Enzymology* vol. 182 (Academic Press, 1997).

The activity of Dkk, a Dkk interacting protein, or a complex of Dkk with LRP5/LRP6/HBM may be affected by compounds which modulate the interaction between Dkk and a Dkk interacting protein (such as those shown in FIG. 5) and/or Dkk and LRP5/LRP6/HBM. The present invention provides methods and research tools for the discovery and characterization of these compounds. The interaction between Dkk and a Dkk interacting protein and/or Dkk and LRP5/6/HBM may be monitored in vivo and in vitro. Compounds which modulate the stability of a Dkk LRP5/LRP6/HBM complex are potential therapeutic compounds. Example in vitro methods include: Binding LRP5/6/HBM, Dkk, or a Dkk interacting protein to a sensor chip designed for an instrument such are made by Biacore (Uppsala, Sweden) for the performance of an plasmon resonance spectroscopy observation. In this method, the chip with one of Dkk, a Dkk interacting protein, or LRP5/6 is first exposed to the other under conditions which permit them to form the complex. A test compound is then introduced and the output signal of the instrument provides an indication of any effect exerted by the test compound. By this method, compounds may be rapidly screened. Another, in vitro, method is exemplified by the SAR-by-NMR methods (Shuker et al., *Science.* 274:1531-4 (1996)). Briefly, a Dkk-1 binding domain and/or LRP 5 or 6 LBD are expressed and purified as $^{15}$N labeled protein by expression in labeled media. The labeled protein(s) are allowed to form the complex in solution in an NMR sample tube. The heteronuclear correlation spectrum in the presence and absence of a test compound provides data at the level of individual residues with regard to interactions with the test compound and changes at the protein-protein interface of the complex. One of skill in the art knows of many other protocols, e.g. affinity capillary electrophoresis (Okun et al. *J Biol Chem* 276:1057-62 (2001); Vergun and Chu, *Methods*, 19:270-7 (1999)), fluorescence spectroscopy, electron paramagnetic resonance, etc. which can monitor the modulation of a complex and/or measure binding affinities for complex formation.

In vitro protocols for monitoring the modulation of a Dkk/LRP5/LRP6/HBM complex include the yeast two hybrid protocol. The yeast two hybrid method may be used to monitor the modulation of a complex in vivo by monitoring the expression of genes activated by the formation of a complex of fusion proteins of Dkk and LRP ligand binding domains. Nucleic acids according to the invention which encode the interacting Dkk and LRP LBD domains are incorporated into bait and prey plasmids. The Y2H protocol is performed in the presence of one or more test compounds. The modulation of the complex is observed by a change in expression of the complex activated gene. It will be appreciated by one skilled in the art that test compounds can be added to the assay directly or, in the case of proteins, can be coexpressed in the yeast with the bait and prey compounds. Similarly, fusion proteins of Dkk and Dkk interacting proteins can also be used in a Y2H screen to identify other proteins which modulate the Dkk/Dkk interacting protein complex.

Assay protocols such as these may be used in methods to screen for compounds, drugs, treatments which modulate the Dkk/Dkk interacting protein and/or Dkk/LRP5/6 complex, whether such modulation occurs by competitive binding, or by altering the structure of either LRP 5/6 or Dkk at the binding site, or by stabilizing or destablizing the protein-protein interface. It may be anticipated that peptide aptamers may competitively bind, although induction of an altered binding site structure by steric effects is also possible.

12.1 Antibodies and Antibody Fragments

Polyclonal and monoclonal antibodies and fragments of these antibodies which bind to Dkk or LRP5/LRP6/HBM can be prepared as would be known in the art. For example, suitable host animals can be immunized using appropriate immunization protocols and the peptides, polypeptides or proteins of the invention. Peptides for use in immunization are typically about 8-40 residues long. If necessary or desired, the polypeptide immunogens can be conjugated to suitable carriers. Methods for preparing immunogenic conjugates with carriers such as bovine serum albumin (BSA), keyhole limpet hemocyanin (KLH), or other carrier proteins are well known in the art (See, Harlow et al., 1988). In some circumstances, direct conjugation using, for example, carbodiimide reagents, may be effective; in other instances linking reagents such as those supplied by Pierce Chemical Co., Rockford, Ill., may be desirable to provide accessibility to the polypeptide or hapten. The hapten peptides can be extended at either the amino or carboxy terminus with a cysteine residue or interspersed with cysteine residues, for example, to facilitate linking to a carrier. Administration of the immunogens is conducted generally by injection over a suitable time period and with use of suitable adjuvants, as is generally understood in the art. During the immunization schedule, titers of antibodies are taken to determine adequacy of antibody formation.

Anti-peptide antibodies can be generated using synthetic peptides, for example, the peptides derived from the sequence of any Dkk, including Dkk-1, or LRP5/LRP6/HBM. Synthetic peptides can be as small as 2-3 amino acids in length, but are preferably at least 3, 5, 10, or 15 or more amino acid residues long. Such peptides can be determined using programs such as DNAStar. The peptides are coupled to KLH using standard methods and can be immunized into animals such as rabbits. Polyclonal anti-Dkk or anti-LRP5/LRP6/HBM peptide antibodies can then be purified, for example using Actigel beads containing the covalently bound peptide.

While the polyclonal antisera produced in this way may be satisfactory for some applications, for pharmaceutical compositions, use of monoclonal preparation is preferred. Immortalized cell lines which secrete the desired monoclonal antibodies may be prepared using the standard method of Kohler and Milstein or modifications which effect immortalization of lymphocytes or spleen cells, as is generally known (See, e.g., Harlow et al. 1988 and 1998). The immortalized cell lines secreting the desired antibodies can be screened by immunoassay in which the antigen is the peptide hapten, polypeptide or protein. When the appropriate immortalized cell culture secreting the desired antibody is identified, the cells can be cultured either in vitro or by production in ascites fluid.

The desired monoclonal antibodies are then recovered from the culture supernatant or from the ascites supernatant. Fragments of the monoclonal antibodies which contain the immunologically significant portion can be used as agonists or antagonists of Dkk activity. Use of immunologically reactive fragments, such as the Fab, scFV, Fab', of F(ab')$_2$ fragments are often preferable, especially in a therapeutic context, as these fragments are generally less immunogenic than the whole immunoglobulin.

The antibodies or fragments may also be produced, using current technology, by recombinant means. Regions that bind specifically to the desired regions of Dkk or LRP5/LRP6/HBM can also be produced in the context of chimeras with multiple species origin. Antibody reagents so created are contemplated for use diagnostically or as stimulants or inhibitors of Dkk activity.

In one embodiment, antibodies against Dkk, bind Dkk with high affinity, i.e., ranging from $10^{-5}$ to $1^{-9}$ M. Preferably, the anti-Dkk antibody will comprise a chimeric, primate, Primatized®, human or humanized antibody. Also, the invention embraces the use of antibody fragments, e.g., Fab's, Fv's, Fab's, F(ab)$_2$, and aggregates thereof.

Another embodiment contemplates chimeric antibodies which recognize Dkk or LRP5/LRP6/HBM. A chimeric antibody is intended to refer to an antibody with non-human variable regions and human constant regions, most typically rodent variable regions and human constant regions.

A "primatized® antibody" refers to an antibody with primate variable regions, e.g., QPR's, and human constant regions. Preferably such primate variable regions are derived from an Old World monkey.

A "humanized antibody" refers to an antibody with substantially human framework and constant regions, and non-human complementarity-determining regions (CDRs). "Substantially" refers to the fact that humanized antibodies typically retain at least several donor framework residues (i.e., of non-human parent antibody from which CDRs are derived).

Methods for producing chimeric, primate, primatized®, humanized and human antibodies are well known in the art. See, e.g., U.S. Pat. No. 5,530,101, issued to Queen et al.; U.S. Pat. No. 5,225,539, issued to Winter et al.; U.S. Pat. Nos. 4,816,397 and 4,816,567, issued to Boss et al. and Cabilly et al. respectively, all of which are incorporated by reference in their entirety.

The selection of human constant regions may be significant to the therapeutic efficacy of the subject anti-Dkk or LRP5/LRP6/HBM antibody. In a preferred embodiment, the subject anti-Dkk or LRP5/LRP6/HBM antibody will comprise human, gamma 1, or gamma 3 constant regions and, more preferably, human gamma 1 constant regions.

Methods for making human antibodies are also known and include, by way of example, production in SCID mice, and in vitro immunization.

The subject anti-Dkk or LRP5/LRP6/HBM antibodies can be administered by various routes of administration, typically parenteral. This is intended to include intravenous, intramuscular, subcutaneous, rectal, vaginal, and administration with intravenous infusion being preferred.

The anti-Dkk or LRP5/LRP6/HBM antibody will be formulated for therapeutic usage by standard methods, e.g., by addition of pharmaceutically acceptable buffers, e.g., sterile saline, sterile buffered water, propylene glycol, and combinations thereof.

Effective dosages will depend on the specific antibody, condition of the patient, age, weight, or any other treatments, among other factors. Typically effective dosages will range from about 0.001 to about 30 mg/kg body weight, more preferably from about 0.01 to 25 mg/kg body weight, and most preferably from about 0 1 to about 20 mg/kg body weight.

Such administration may be effected by various protocols, e.g., weekly, bi-weekly, or monthly, depending on the dosage administered and patient response. Also, it may be desirable to combine such administration with other treatments.

Antibodies to Dkk-1 interacting proteins, such as those identified in FIG. 5, are also contemplated according to the present invention, and can be used similarly to the Dkk-1 antibodies mentioned in the above methodology.

The antibodies of the present invention can be utilized in experimental screening, as diagnostic reagents, and in therapeutic compositions.

12.2 Chemical Libraries

Agents that are assayed by these methods can be randomly selected or rationally selected or designed. As used herein, an agent is said to be randomly selected when the agent is chosen randomly without considering the specific sequences involved in the association of Dkk-1 alone, Dkk-1 interacting proteins alone, or with their associated substrates, binding partners, etc. An example of randomly selected agents is the use of a chemical library or a peptide combinatorial library, or a growth broth of an organism.

The agents of the present invention can be, as examples, peptides, small molecules, vitamin derivatives, as well as carbohydrates. A skilled artisan can readily recognize that there is no limit as to the structural nature of the agents of the present invention.

12.3 Peptide Synthesis

The peptide agents of the invention can be prepared using standard solid phase (or solution phase) peptide synthesis methods, as is known in the art. In addition, the DNA encoding these peptides may be synthesized using commercially available oligonucleotide synthesis instrumentation and produced recombinantly using standard recombinant production systems. The production of polypeptides using solid phase peptide synthesis is non-nucleic acid-encoded amino acids are to be included.

13. Uses for Agents that Modulate at Least One Activity of Dkk, a Dkk Interacting Protein a Dkk/Dkk Interacting Protein Complex or a Dkk/LRP5 or Dkk/LRP6 Complex The proteins and nucleic acids of the invention, such as the proteins or polypeptides containing an amino acid sequence of LRP5, Dkk, and Dkk interacting proteins are involved in bone mass modulation and lipid modulation of other Wnt pathway mediated activity. Agents that modulate (i.e., up and down-regulate) the expression of Dkk or Dkk interacting proteins, or agents, such as agonists and antagonists respectively, of at least one activity of Dkk or a Dkk interacting protein may be used to modulate biological and pathologic processes associated with the function and activity of Dkk or a Dkk interacting protein.

As used herein, a subject can be preferably any mammal, so long as the mammal is in need of modulation of a pathological or biological process modulated by a protein of the invention. The term "mammal" means an individual belonging to the class Mammalia. The invention is particularly useful in the treatment of human subjects.

As used herein, a biological or pathological process modulated by Dkk or a Dkk interacting protein may include binding of Dkk to a Dkk interacting protein, Dkk to LRP5 or LRP6 or release therefrom, inhibiting or activating Dkk or a Dkk interacting protein mRNA synthesis or inhibiting Dkk or Dkk interacting protein modulated inhibition of LRP5 or LRP6 mediated Wnt signaling. Further bone-related markers may be observed such as alkaline phosphatase activity, osteocalcin production, or mineralization.

Pathological processes refer to a category of biological processes which produce a deleterious effect. For example, expression or up-regulation of expression of LRP5 or LRP6 and/or Dkk and/or a Dkk interacting protein may be associated with certain diseases or pathological conditions. As used herein, an agent is said to modulate a pathological process when the agent statistically significantly (p<0.05) alters the process from its base level in the subject. For example, the agent may reduce the degree or severity of the process mediated by that protein in the subject to which the agent was administered. For instance, a disease or pathological condition may be prevented, or disease progression modulated by the administration of agents which reduce or modulate in some way the expression or at least one activity of a protein of the invention.

As LRP5/6 and Dkk are involved both directly and indirectly in bone mass modulation, one embodiment of this invention is to use Dkk or Dkk interacting protein expression as a method of diagnosing a bone condition or disease. Certain markers are associated with specific Wnt signaling conditions (e.g., TCF/LEF activation). Diagnostic tests for bone conditions may include the steps of testing a sample or an extract thereof for the presence of Dkk or Dkk interacting protein nucleic acids (i.e., DNA or RNA), oligomers or fragments thereof or protein products of TCF/LEF regulated expression. For example, standard in situ hybridization or other imaging techniques can be utilized to observe products of Wnt signaling.

This invention also relates to methods of modulating bone development or bone loss conditions. Inhibition of bone loss may be achieved by inhibiting or modulating changes in the LRP5/6 mediated Wnt signaling pathway. For example, absence of LRP5 activity may be associated with low bone mass. Increased activity LRP5 may be associated with high bone mass. Therefore, modulation of LRP5 activity will in turn modulate bone development. Modulation of the Dkk/LRP5/6 or Dkk/Dkk interacting protein complex via agonists and antagonists is one embodiment of a method to regulate bone development. Such modulation of bone development can result from inhibition of the activity of, for example, a Dkk/LRP(5/6) protein complex, a Dkk/Dkk interacting protein complex, upregulated transcription of the LRP5 gene or inhibited translation of Dkk or Dkk interacting protein mRNA.

The agents of the present invention can be provided alone, or in combination with other agents that modulate a particular pathological process. As used herein, two agents are said to be administered in combination when the two agents are administered simultaneously or are administered independently in a fashion such that the agents will act at the same time.

The agents of the present invention can be administered via parenteral, subcutaneous (sc), intravenous (iv), intramuscular (im), intraperitoneal (ip), transdermal or buccal routes. Alternatively, or concurrently, administration may be by the oral route. The dosage administered will be dependent upon the age, health, and weight of the recipient, kind of concurrent treatment, if any, frequency of treatment, and the nature of the effect desired.

The present invention further provides compositions containing one or more agents which modulate expression or at least one activity of a protein of the invention. While individual needs vary, determination of optimal ranges of effective amounts of each component is within the skill of the art. Typical dosages of the active agent which mediate Dkk or Dkk interacting protein activity comprise from about 0.0001 to about 50 mg/kg body weight. The preferred dosages comprise from about 0.001 to about 50 mg/kg body weight. The most preferred dosages comprise from about 0.1 to about 1 mg/kg body weight. In an average human of 70 kg, the range would be from about 7 μg to about 3.5 g, with a preferred range of about 0.5 mg to about 5 mg.

In addition to the pharmacologically active agent, the compositions of the present invention may contain suitable pharmaceutically acceptable carriers comprising excipients and auxiliaries which facilitate processing of the active compounds into preparations which can be used pharmaceutically for delivery to the site of action. Suitable formulations for parenteral administration include aqueous solutions of the active compounds in water-soluble form, for example, water-soluble salts. In addition, suspensions of the active compounds as appropriate oily injection suspensions may be administered. Suitable lipophilic solvents or vehicles include-fatty oils, for example, sesame oil, or synthetic fatty acid esters, (e.g., ethyl oleate or triglycerides). Aqueous injection suspensions may contain substances which increase the viscosity of the suspension include, for example, sodium carboxymethyl cellulose, sorbitol and/or dextran. Optionally, the suspension may also contain stabilizers. Liposomes and other non-viral vectors can also be used to encapsulate the agent for delivery into the cell.

The pharmaceutical formulation for systemic administration according to the invention may be formulated for enteral, parenteral, or topical (top) administration. Indeed, all three types of formulations may be used simultaneously to achieve systemic administration of the active ingredient.

Suitable formulations for oral administration include hard or soft gelatin capsules, pills, tablets, including coated tablets, elixirs, suspensions, syrups or inhalations and controlled release forms thereof.

Potentially, any compound which binds Dkk or a Dkk interacting protein or modulates the Dkk/LRP5 or Dkk/LRP6 or Dkk/Dkk interacting protein complex may be a therapeutic compound. In one embodiment of the invention, a peptide or nucleic acid aptamer according to the invention is used in a therapeutic composition. Such compositions may comprise an aptamer, or a LRP5 or LRP6 fragment unmodified or modified. In another embodiment, the therapeutic compound comprises a Dkk-1 interacting protein, or biologically active fragment thereof.

Nucleic acid aptamers have been used in compositions for example by chemical bonding to a carrier molecule such as polyethylene glycol (PEG) which may facilitate uptake or stabilize the aptamer. A di-alkylgylcerol moiety attached to an RNA will embed the aptamer in liposomes, thus stabilizing the compound. Incorporating chemical substitutions (i.e. changing the 2' OH group of ribose to a 2' NH in RNA confers ribonuclease resistance) and capping, etc. can prevent breakdown. Several such techniques are discussed for RNA aptamers in Brody and Gold (*Rev. Mol. Biol.* 74:3-13 (2000)).

Peptide aptamers may by used in therapeutic applications by the introduction of an expression vector directing aptamer expression into the affected tissue such as for example by retroviral delivery, by encapsulating the DNA in a delivery complex or simple by naked DNA injection. Or, the aptamer itself or a synthetic analog may be used directly as a drug. Encapsulation in polymers and lipids may assist in delivery. The use of peptide aptamers as therapeutic and diagnostic agents is reviewed by Hoppe-Syler and Butz (*J. Mol. Med.* 78:426-430 (2000)).

In another aspect of the invention. The structure, of a constrained peptide aptamer of the invention may be determined such as by NMR or X-ray crystallography. (Cavanagh et al., *Protein NMR Spectroscopy: Principles and Practice*, Academic. Press, 1996; Drenth, *Principles of Protein X-Ray Crystallography*, Springer Verlag, 1999) Preferably the structure is determined in complex with the target protein. A small molecule analog is then designed according to the positions of functional elements of the 3D structure of the aptamer. (*Guidebook on Molecular Modeling in Drug Design*, Cohen, Ed., Academic Press, 1996; *Molecular Modeling and Drug Design (Topics in Molecular and Structural Biology)*, Vinter and Gardner Eds., CRC Press, 1994) Thus the present invention provides a method for the design of effective and specific drugs which modulate the activity of Dkk, Dkk interacting proteins, Dkk/Dkk interacting protein complex and the Dkk/LRP complex. Small molecule mimetics of the peptide aptamers of the present invention are encompassed within the scope of the invention.

In practicing the methods of this invention, the compounds of this invention may be used alone or in combination, or in combination with other therapeutic or diagnostic agents. In certain preferred embodiments, the compounds of this invention may be co-administered along with other compounds typically prescribed for these conditions according to generally accepted medical practice. For example, the compounds of this invention can be administered in combination with other therapeutic agents for the treatment of bone loss. Bone loss mediating agents include bone resorption inhibitors such as bisphosphonates (e.g., alendronic acid, clodronic acid, etidronic acid, pamidronic acid, risedronic acid and tiludronic acid), vitamin D and vitamin D analogs, cathepsin K inhibitors, hormonal agents (e.g., calcitonin and estrogen), and selective estrogen receptor modulators or SERMs (e.g., raloxifene). And bone forming agents such as parathyroid hormone (PTH) and bone morphogenetic proteins (BMP).

Additionally contemplated are combinations of agents which regulate Dkk-1 and agents which regulate lipid levels such as HMG-CoA reductase inhibitors (i.e., statins such as Mevacor®, Lipitor® and other inhibitors such as Baycol®, Lescol®, Pravachol® and Zocor®), bile acid sequestrants (e.g., Colestid® and Welchol®)), fibric acid derivatives (Atromid-S®, Lopid®), Tricor®), and nicotinic acid.

The compounds of this invention can be utilized in vivo, ordinarily in vertebrates and preferably in mammals, such as humans, sheep, horses, cattle, pigs, dogs, cats, rats and mice, or in vitro.

14. Transgenic Animals

Transgenic animal models can be created which conditionally express Dkk and/or LRP5 or LRP6 and/or Dkk interacting proteins, such as those shown in FIG. 5. These animals can be used as research tools for the study of the physiological effects of the Dkk-1/Dkk-1 interacting protein interaction and/or the LRP5/Dkk interaction.

Alternatively, transgenic animals can be created which express a transgenic form of Dkk alone or in addition to a transgenic form of HBM or express Dkk interacting proteins alone or in addition to a transgenic form of Dkk. Transgenic animals expressing HBM or LRP5 can be crossed with transgenic animals expressing Dkk or Dkk interacting proteins to obtain heterozygote as well as homozygote animals which express both desired genes.

Animal models may be created to directly modulate the Dkk/Dkk interacting protein or Dkk/LRP5 interaction activity in vivo to serve as a research tool for determining the efficacy of candidate compounds which modulate the Dkk/Dkk interacting protein or LRP5/Dkk interaction activity in vitro. Animals, such as transgenic mice, can be created using the techniques employed to make transgenic mice that express for example, human Dkk or a Dkk interacting protein, or knockouts (KO), which may be conditional, of the gene encoding mouse Dkk or Dkk interacting protein. Knock-in animals include animals wherein genes have been introduced and animals wherein a gene that was previously knocked-out is reintroduced into the animal. Other transgenic animals can be created with inducible forms of Dkk or a Dkk interacting protein to study the effects of the gene on bone mass development and loss as well as lipid level regulation. These animals can also be used to study long term effects of Dkk or Dkk interacting protein modulation. Transgenic animals may be created to express peptide aptamers, or produce RNA aptamers. The transgenic vectors may direct expression in a tissue specific manner by the use of tissue specific promoters. In a preferred embodiment, a peptide aptamer fusion protein is expressed using a bone specific promoter. Such systems can provide a tissue specific knock-out of Dkk or Dkk interacting protein activity.

General methods for creating transgenic animals are known in the art, and are described in, for example, *Strategies in Transgenic Animal Science* (Glenn M. Monastersky and James M. Robl eds., ASM Press; Washington, DC, 1995); *Transgenic Animal Technology: A Laboratory Handbook* (Carl A. Pinkert ed., Academic Press 1994); *Transgenic Animals* (Louis Marie Houdebine, ed., Harwood Academic Press, 1997); *Overexpression and Knockout of Cytokines in Transgenic Mice* (Chaim O. Jacob, ed., Academic Press 1994); *Microinjection and Transgenesis: Strategies and Protocols* (Springer Lab Manual) (Angel Cid-Arregui and Alejandro Garcia-Carranca, eds., Springer Verlag 1998); and *Manipulating the Mouse Embryo: A Laboratory Manual* (Brigid Hogan et al., eds., Cold Spring Harbor Laboratory Press 1994).

15. Peptide and Nucleotide Aptamers and Peptide Aptamer Mimetics

Another embodiment contemplates the use of peptide and nucleotide aptamer technology to screen for agents which interact with Dkk, which block Dkk from interacting with LRP5 or LRP6, or which block any other Dkk ligand interaction, or which interact with Dkk interacting proteins, such as those shown in FIG. 5. Peptide aptamers are molecules in which a variable peptide domain is displayed from a scaffold protein. Thioredoxin A (trxA) is commonly used for a scaffold. The peptide insert destroys the catalytic site of trxA. It is recognized that numerous proteins may also be used as scaffolding proteins to constrain and/or present a peptide aptamer. Other scaffold proteins that could display a constrained peptide aptamer could include *staphylococcal* nuclease, the protease inhibitor eglin C, the *Streptomyces tendea* alpha-amylase inhibitor Tendamistat, Sp1, and green fluorescent protein (GFP) (reviewed in Hoppe-Seyler et al., *J. Steroid Biochem Mol. Biol.* 78:105-11 (2001)), and the S1 nuclease from *Staphylococcus* or M13 for phage display. Any molecule to which the aptamer could be anchored and presented in its bioactive conformation would be suitable.

Aptamers can then specifically bind to a given target protein in vitro and in vivo and have the potential to selectively block the function of their target protein. Peptide aptamers are selected from randomized expression libraries on the basis of their in vivo binding capacity to the desired target protein. Briefly, a target protein (e.g., Dkk, a Dkk interacting protein, or LRP5/6) is linked to a heterologous DNA binding domain (BD) and expressed as bait in a yeast test strain. Concomitantly, a library coding for different peptides (e.g., 16-mers) of randomized sequence inserted in a scaffold protein sequence, which are linked to a heterologous transcriptional activation domain (AD) is expressed as prey. If a peptide binds to a target protein, a functional transcription factor is reconstituted, in which the BD and AD are bridged together by interacting proteins. This transcription factor is then able to activate the promoter of a marker gene which can be monitored by colorimetric enzymatic assays or by growth selection. Additional variation, methods of preparing and screening methodologies are described in, for example, Hoppe-Seyler et al., *J. Mol. Med.* 78: 426-430 (2000).

Nucleotide aptamers are described for example in Brody et al., *Trends Mol. Biotechnol.* 74: 5-13 (2000). Additional methods of making and using nucleotide aptamers include SELEX, i.e., Systematic Evolution of Ligands by Exponential Enrichment. SELEX is a process of isolating oligonucleotide ligands of a chosen target molecule (see Tuerk and Gold, *Science* 249:505-510 (1990); U.S. Pat. Nos. 5,475,096, 5,595,877, and 5,660,985). SELEX, as described in Tuerk and Gold, involves admixing the target molecule with a pool of oligonucleotides (e.g., RNA) of diverse sequences; retaining complexes formed between the target and oligonucleotides; recovering the oligonucleotides bound to the target; reverse-transcribing the RNA into DNA; amplifying the DNA with polymerase chain reactions (PCR); transcribing the amplified DNA into RNA; and repeating the cycle with ever increasing binding stringency. Three enzymatic reactions are required for each cycle. It usually takes 12-15 cycles to isolate aptamers of high affinity and specificity to the target. An aptamer is an oligonucleotide that is capable of binding to an intended target substance but not other molecules under the same conditions.

In another reference, Bock et al., *Nature* 355:564-566 (1990), describe a different process from the SELEX method of Tuerk and Gold in that only one enzymatic reaction is required for each cycle (i.e., PCR) because the nucleic acid library in Bock's method is comprised of DNA instead of RNA. The identification and isolation of aptamers of high specificity and affinity with the method of Bock et al. still requires; repeated cycles in a chromatographic column.

Other nucleotide aptamer methods include those described by Conrad et al., *Meth. Enzymol.* 267:336-367 (1996). Conrad et al. describe a variety of methods for isolating aptamers, all of which employ repeated cycles to enrich target-bound ligands and require a large amount of purified target molecules. More recently described methods of making and using nucleotide aptamers include, but are not limited to those described in U.S. Pat. Nos. 6,180,348; 6,051,388; 5,840,867; 5,780,610, 5,756,291 and 5,582,981.

Potentially, any compound which binds Dkk or a Dkk interacting protein or modulates the Dkk/Dkk interacting protein or Dkk/LRP5 or Dkk/LRP6 complex may be a therapeutic compound. In one embodiment of the invention, a peptide or nucleic acid aptamer according to the invention is used in a therapeutic composition. Such compositions may comprise an aptamer, or a LRP5 or LRP6 fragment unmodified or modified.

Nucleic acid aptamers have been used in compositions for example by chemical bonding to a carrier molecule such as polyethylene glycol (PEG) which may facilitate uptake or stabilize the aptamer. A di-alkylglycerol moiety attached to an RNA will embed the aptamer in liposomes, thus stabilizing the compound. Incorporating chemical substitutions (i.e., changing the 2'-OH group of ribose to a 2'-NH in RNA confers ribonuclease resistance) and capping, etc. can prevent breakdown. Several such techniques are discussed for RNA aptamers in Brody and Gold Rev. Mol. Biol. 74:3-13 (2000).

Peptide aptamers may by used in therapeutic applications by the introduction of an expression vector directing aptamer expression into the affected tissue such as for example by retroviral delivery, by encapsulating the DNA in a delivery complex or simple by naked DNA injection. Or, the aptamer itself or a synthetic analog may be used directly as a drug. Encapsulation in polymers and lipids may assist in delivery. The use of peptide aptamers as therapeutic and diagnostic agents is reviewed by Hoppe-Syler and Butz *J. Mol. Med.* 78:426-430 (2000).

In another aspect of the invention, the structure of a constrained peptide aptamer of the invention may be determined such as by NMR or X-ray crystallography. (Cavanagh et al., *Protein NMR Spectroscopy: Principles and Practice*, Academic Press, 1996; Drenth, *Principles of Protein X-Ray Crystallography*, Springer Verlag, 1999) Preferably the structure is determined in complex with the target protein. A small molecule analog is then designed according to the positions of functional elements of the 3D structure of the aptamer. (*Guidebook on Molecular Modeling in Drug Design*, Cohen, Ed., Academic Press, 1996; *Molecular Modeling and Drug Design* (*Topics in Molecular and Structural Biology*), Vinter and Gardner Eds., CRC Press, 1994) Thus, a method is provided for the design of effective and specific drugs which modulate the activity of Dkk, Dkk interacting proteins, Dkk/Dkk interacting protein complex, and the Dkk/LRP complex. Small molecule mimics of the peptide aptamers of the present invention are also encompassed within the scope of the invention.

16. Alternative Variants of LRP5/LRP6 Having HBM Activity

A structural model of the LRP5/Zmax1 first beta-propeller module was generated based on a model prediction in Springer et al., (1998) *J. Molecular Biology*, 283:837-862. Based on the model, certain amino acid residues were identified as important variants of LRP5/HBM/Zmax1. The following three categories provide examples of such variants:

The shape of the beta-propeller resembles a disk with inward-sloping sides and a hole down the middle. Residue 171 is in a loop on the outer or top surface of the domain in blade 4 of propeller module 1. Thus, variants comprising changed residues in structurally equivalent positions in other blades; as well as residues that are slightly more interior to the binding pocket, but still accessible to the surface, are important embodiments of the present invention for the study of bone mass modulation by LRP5/HBM, for the development of pharmaceuticals and treatments of bone mass disorders, and for other objectives of the present invention. The following are examples of such variants:

- A214V (a position equivalent to 171 in blade 5; alanine is not conserved in other propellers),
- E128V (a position-equivalent to 171 in blade 3; glutamate is not conserved in other propellers),
- A65V (a position equivalent to 171 in blade 2; alanine is conserved in propellers 1-3 but not 4),
- G199V (an accessible interior position in blade 5; glycine is conserved in propellers 1-3 but not 4), and
- M282V (accessible interior position in blade 1; methionine is conserved in propellers 1-3 but not 4).

LRP5/Zmax1 has four beta-propeller structures; the first three beta-propeller modules conserve a glycine in the position corresponding to residue 171 in human LRP5/Zmax1. Therefore, variants bearing a valine in the equivalent positions in the other propellers are important embodiments of the present invention. The following variants are useful for the study of bone mass modulation by LRP5/HBM, for the development of pharmaceuticals and treatments of bone mass disorders, and for other objectives of the present invention: G479V, G781V, and Q1087V.

The G171V HBM polymorphism results in "occupied space" of the beta-propeller 1, with the side-chain from the valine residue sticking out into an open binding pocket and potentially altering a ligand/protein interaction. The glycine residue is conserved in LRP5/Zmax1 propellers 1, 2 and 3 but is a glutamine in propeller 4. Therefore, the following variants of LRP5/HBM are important embodiments of the present invention for the study of bone mass modulation by LRP5/HBM, for the development of pharmaceuticals and treatments of bone mass disorders, and for other objectives of the present invention:

G171K (which introduces a charged side-chain),
G171F (which introduces a ringed side-chain),
G171I (which introduces a branched side-chain), and
G171Q (which introduces the propeller4 residue).

Furthermore, LRP6 is the closest homolog of LRP5/Zmax1. LRP6 has a beta-propeller structure predicted to be similar, if not identical to Zmax1. The position corresponding to glycine 171 in human LRP5/Zmax1 is glycine 158 of human LRP6. Thus, corresponding variants of LRP6 are an important embodiment of the present invention for the study of the specificity of LRP5/Zmax1 versus its related family member, for the development of pharmaceuticals and treatments of bone mass disorders, and for other objectives of the present invention. Specifically, for example, a glycine to valine substitution at the structurally equivalent position, residue 158, of human LRP6 and similar variants of other species' LRP6 homologs represent important research tools.

Site-directed mutants of LRP5 were generated in the full-length human LRP5 cDNA using the QuikChange XL-Site-Directed Mutagenesis Kit (catalog #200516, Stratagene, La Jolla, Calif.) following the manufacturers protocol. The mutant sequences were introduced using complementary synthetic oligonucleotides:

```
A65V:                              (SEQ ID NO: 129)
TGGTCAGCGGCCTGGAGGATGTGGCCGCAGTGGACTTCC
and (SEQ ID NO: 130)
GGAAGTCCACTGCGGCCACATCCTCCAGGCCGCTGACCA E128V:                             (SEQ ID NO: 131)
AAGCTGTACTGGACGGACTCAGTGACCAACCGCATCGAGG
and (SEQ ID NO: 132)
CCTCGATGCGGTTGGTCACTGAGTCCGTCCAGTACAGCTT G171K:                             (SEQ ID NO: 133)
ATGTACTGGACAGACTGGAAGGAGACGCCCCGGATTGAGCG
and (SEQ ID NO: 134)
CGCTCAATCCGGGGCGTCTCCTTCCAGTCTGTCCAGTACAT G171F:                             (SEQ ID NO: 135)
ATGTACTGGACAGACTGGTTTGAGACGCCCCGGATTGAGCG
and (SEQ ID NO: 136)
CGCTCAATCCGGGGCGTCTCAAACCAGTCTGTCCAGTACAT G171I:                             (SEQ ID NO: 137)
ATGTACTGGACAGACTGGATTGAGACGCCCCGGATTGAGCG
and (SEQ ID NO: 138)
CGCTCAATCCGGGGCGTCTCAATCCAGTCTGTCCAGTACAT G171Q:                             (SEQ ID NO: 139)
ATGTACTGGACAGACTGGCAGGAGACGCCCCGGATTGAGCG
and (SEQ ID NO: 140)
CGCTCAATCCGGGGCGTCTCCTGCCAGTCTGTCCAGTACAT G199V:                             (SEQ ID NO: 141)
CGGACATTTACTGGCCCAATGTACTGACCATCGACCTGGAGG
and (SEQ ID NO: 142)
CCTCCAGGTCGATGGTCAGTACATTGGGCCAGTAAATGTCCG A214V:                             (SEQ ID NO: 143)
AGCTCTACTGGGCTGACGTCAAGCTCAGCTTCATCCACCG
and (SEQ ID NO: 144)
CGGTGGATGAAGCTGAGCTTGACGTCAGCCCAGTAGAGCT M282V:                             (SEQ ID NO: 145)
GAGTGCCCTCTACTCACCCGTGGACATCCAGGTGCTGAGCC
and (SEQ ID NO: 146)
GGCTCAGCACCTGGATGTCCACGGGTGAGTAGAGGGCACTC G479V:                             (SEQ ID NO: 147)
CATGTACTGGACAGACTGGGTAGAGAACCCTAAAATCGAGTGTGC
and (SEQ ID NO: 148)
GCACACTCGATTTTAGGGTTCTCTACCCAGTCTGTCCAGTACATG G781V:                             (SEQ ID NO: 149)
CATCTACTGGACCGAGTGGGTCGGCAAGCCGAGGATCGTGCG
and (SEQ ID NO: 150)
CGCACGATCCTCGGCTTGCCGACCCACTCGGTCCAGTAGATG Q1087V:                            (SEQ ID NO: 151)
GTACTTCACCAACATGGTGGACCGGGCAGCCAAGATCGAACG
and (SEQ ID NO: 152)
CGTTCGATCTTGGCTGCCCGGTCCACCATGTTGGTGAAGTAC LRP6 G158V:                        (SEQ ID NO: 153)
GTACTGGACAGACTGGGTAGAAGTGCCAAAGATAGAACGTGC
and (SEQ ID NO: 154)
GCACGTTCTATCTTTGGCACTTCTACCCAGTCTGTCCAGTAC.
```

All constructs were sequence verified to ensure that only the engineered modification was present in the gene. Once verified, each variant was functionally evaluated in the TCF-luciferase assay in U2OS cells (essentially as described in Example 7. Other functional evaluations could also be performed, such as the *Xenopus* embryo assay (essentially as described in Example 6), or other assays to evaluate Wnt signaling, Dkk modulation, or anabolic bone effect. Binding of these mutants to Dkk, LRP-interacting proteins, Dkk-interacting proteins, or peptide aptamers to any of the preceding could also be investigated in a variety of ways such as in a two-hybrid system (such as in yeast as described in this application), or other methods.

FIG. 24 shows the effects of the G171F mutation in propeller 1 of LRP5. This mutation is at the same position as HBM's G171V substitution. Expression of G171F results in an HBM effect. That is, in the presence of Wnt, G171 F is able to activate the TCF-luciferase reporter construct. In fact, it may activate the reporter to a greater extent than either LRP5 or HBM. Furthermore, in the presence of Dkk1 and Wnt1, G171 F is less susceptible than LRP5 to modulation by Dkk. These data exemplify that the G171 F variant modulates Wnt signaling in a manner similar to HBM. In addition, this data confirms that HBM's valine residue at 171 is not the only modification at 171 that can result in an HBM effect. Together these data support an important role for LRP5 propeller 1 in modulating Wnt pathway activity; in responding to Dkk modulation; and, in the ability to generate an HBM effect.

FIG. 25 shows the effects of the M282V mutation in propeller 1 of LRP5. M282 expression results in an HBM-effect. That is, in the presence of Wnt, M282 is able to activate the TCF-luciferase reporter construct. Furthermore, in the presence of Dkk1 and Wnt1, M282V is less susceptible than LRP5 to modulation by Dkk. These data show that the M282V variant modulates Wnt signaling in a manner similar to HBM. In addition, this data confirms that modifications of other residues in propeller 1 of LRP5 can result in an HBM effect.

These data support an "occupied space" model of the HBM mutation in propeller 1 and show that multiple mutations of propeller 1 are capable of generating an HBM effect; the original G171V HBM mutation is not unique in this ability. Moreover, various perturbations in propeller 1 can modulate Dkk activity.

These data illustrate the molecular mechanism of Dkk modulation of LRP signaling. Using the methods disclosed herein and in U.S. application Ser. No. 60/290,071, generation of a comprehensive mutant panel will reveal residues in LRP that function in Dkk modulation of Wnt signaling. Such variants of LRP5 and LRP6 that modulate Dkk activity and the residues which distinguish them from LRP5 and LRP6 are points for therapeutic intervention by small molecule compound, antibody, peptide aptamer, or other agents. Furthermore, models of each HBM-effect mutation/polymorphism may be used in rational drug design of an HBM mimetic agent.

These are only a few illustrative examples presented to better describe the present invention. Variants of LRP5 which have demonstrated HBM activity in assays include G171F, M282V, G171K, G171Q and A214V. Clearly, other variants may be contemplated within the scope of the present invention. Furthermore, wherever HBM is recited in the methods of the invention, it should be understood that any such alternative variant of LRP which demonstrates HBM biological activity is also encompassed by those claims.

17. Screening Assays

The two-hybrid system is extremely useful for studying protein:protein interactions. See, e.g., Chien et al., *Proc. Natl Acad. Sci. USA* 88:9578-82 (1991); Fields et al., *Trends Genetics* 10:286-92 (1994); Harper et al, *Cell* 75:805-16 (1993); Vojtek et al, *Cell* 74:205-14 (1993); Luban et al., *Cell* 73:1067-78 (1993); Li et al., *FASEB J.* 7:957-63 (1993); Zang et al., *Nature* 364:308-13 (1993); Golemis et al., *Mol. Cell. Biol.* 12:3006-14 (1992); Sato et al., *Proc. Natl Acad. Sci. USA* 91:923842 (1994); Coghlan et al. *Science* 267:108-111. (1995); Kalpana et al., *Science* 266:2002-6 (1994); Helps et al., *FEBS Lett.* 340:93-8 (1994); Yeung et al., *Genes & Devel.* 8:2087-9 (1994); Durfee et al., *Genes & Devel.* 7:555-569 (1993);. Paetkau et al, *Genes & Devel.* 8:2035-45; Spaargaren et al., 1994 *Proc. Natl. Acad. Sci. USA* 91:12609-13 (1994); Ye et al., *Proc. Natl Acad. Sci. USA* 91:12629-33 (1994); and U.S. Pat. Nos. 5,989,808; 6,251,602; and 6,284,519.

Variations of the system are available for screening yeast phagemid (see, e.g., Harper, *Cellular Interactions and Development: A Practical Approach*, 153-179 (1993); Elledge et al., *Proc. Natl Acad. Sci. USA* 88:1731-5 (1991)) or plasmid (Bartel, 1993 and Bartel, Cell 14:920-4 (1993)); Finley et al., *Proc. Natl Acad. Sci. USA* 91:12980-4 (1994)) cDNA libraries to clone interacting proteins, as well as for studying known protein pairs.

The success of the two-hybrid system relies upon the fact that the DNA binding and polymerase activation domains of many transcription factors, such as GAL4, can be separated and then rejoined to restore functionality (Morin et al., *Nuc. Acids Res.* 21:2157-63 (1993)). While these examples describe two-hybrid screens in the yeast system, it is understood that a two-hybrid screen may be conducted in other systems such as mammalian cell lines. The invention is therefore not limited to the use of a yeast two-hybrid system, but encompasses such alternative systems.

Yeast strains with integrated copies of various reporter gene cassettes, such as for example GAL.fwdarw.LacZ, GAL.fwdarw.HIS3 or GAL.fwdarw.URA3 (Bartel, in *Cellular Interactions and Development: A Practical Approach*, 153-179 (1993); Harper et al., *Cell* 75:805-16 (1993); Fields et al., *Trends Genetics* 1.0:286-92 (1994)) are co-transformed with two plasmids, each expressing a different fusion protein. One plasmid encodes a fusion between protein "X" and the DNA binding domain of, for example, the GAL4 yeast transcription activator (Brent et al., *Cell* 43:729-36 (1985); Ma et al., *Cell* 48:847-53 (1987); Keegan et al., *Science* 231:699-704 (1986)), while the other plasmid encodes a fusion between protein "Y" and the RNA polymerase activation domain of GAL4 (Keegan et al., 1986). The plasmids are transformed into a strain of the yeast that contains a reporter gene, such as lacZ, whose regulatory region contains GAL4 binding sites. If proteins X and Y interact, they reconstitute a functional GAL4 transcription activator protein by bringing the two GAL4 components into sufficient proximity to activate transcription. It is well understood that the role of bait and prey proteins may be alternatively switched and thus the embodiments of this invention contemplate and encompass both alternative arrangements.

Either hybrid protein alone must be unable to activate transcription of the reporter gene, the DNA-binding domain hybrid, because it does not provide an activation function, and the activation domain hybrid, because it cannot localize to the GAL4 binding sites. Interaction of the two test proteins reconstitutes the function of GAL4 and results in expression of the reporter gene. The reporter gene cassettes consist of minimal promoters that contain the GAL4 DNA recognition site (Johnson et al., *Mol. Cell. Biol.* 4:1440-8 (1984); Lorch et al., *J. Mol. Biol.* 186:821-824 (1984)) cloned 5' to their TATA box. Transcription activation is scored by measuring either the expression of β-galactosidase or the growth of the transformants on minimal medium lacking the specific nutrient that permits auxotrophic selection for the transcription product, e.g., URA3 (uracil selection) or HIS3 (histidine selection). See, e.g., Bartel, 1993; Durfee et al., *Genes & Devel.* 7:555-569 (1993); Fields et al., *Trends Genet* 10:286-292 (1994); and U.S. Pat. No. 5,283,173.

Generally, these methods include two proteins to be tested for interaction which are expressed as hybrids in the nucleus of a yeast cell. One of the proteins is fused to the DNA-binding domain (DBD) of a transcription factor and the other is fused to a transcription activation domain (AD). If the proteins interact, they reconstitute a functional transcription factor that activates one or more reporter genes that contain binding sites for the DBD. Exemplary two-hybrid assays which have been used for Dkk-1 or Dkk-1/LRP5 are presented in the Examples below.

Additional methods of preparing two hybrid assay systems for Dkk-1 interactors would be evident to one of ordinary skill in the art. See for example, Finley et al., "Two-Hybrid Analysis of Genetic Regulatory Networks," in *The Yeast Two-Hybrid System* (Paul L. Bartel et al., eds., Oxford, 1997); Meijia Yang, "Use of a Combinatorial Peptide Library in the Two- Hybrid Assay," in *The Yeast Two-Hybrid System* (Paul L. Bartel et al., eds., Oxford, 1997); Gietz et al., "Identification of proteins that interact with a protein of interest: Applications of the yeast two-hybrid system," *Mol. & Cell. Biochem.* 172:67-9 (1997); K. H. Young, "Yeast Two-Hybrid: So Many Interactions, (in) so Little Time," *Biol. Reprod.* 58:302-311 (1998); R. Brent et al., "Understanding Gene and Allele Function with Two-Hybrid Methods," *Annu. Rev. Genet* 31:663-704 (1997). It will be appreciated that protein networks can be elucidated by performing sequential screens of activation domain-fusion libraries.

Without further description, it is believed that one of ordinary skill in the art can, using the preceding description and the following illustrative examples, make and utilize the compounds of the present invention and practice the claimed methods. The following working examples therefore, specifically point out preferred embodiments of the present invention, and are not to be construed as limiting in any way the remainder of the disclosure.

EXAMPLES

The present invention is described by reference to the following Examples, which are offered by way of illustration and are not intended to limit the invention in any manner. Standard techniques well-known in the art or the techniques specifically described below were utilized.

For routine practice of the protocols referenced below, one of skill in the art is directed to the references cited in this application as well as the several *Current Protocol* guides, which are continuously updated, widely available and published by John Wiley and Sons, (New York). In the life sciences, *Current Protocols* publishes comprehensive manuals in Molecular Biology, Immunology, Human Genetics, Protein Science, Cytometry, Neuroscience, Pharmacology, Cell Biology, Toxicology, and Nucleic Acid Chemistry. Additional sources are known to one of skill in the art.

Example 1

Yeast Two Hybrid Screen Using LRP5 Ligand Binding Domain (LBD) Bait Sequences

In a screen against human osteoblast library (i.e., HOB03C5, a custom Gibco generated Y2H compatible cDNA library from a human osteoblast cell line as described by Bodine and Komm, *Bone* 25:535-43 (1999)), an interaction with Dkk-1 was identified. The LRP5 ligand binding domain (LBD) baits used for this screen are depicted in FIGS. 2B and C. The basic protocol is as follows:

An overnight culture of the yeast strain containing the bait of interest is grown in 20 ml of appropriate selective medium containing 2% glucose at 30° C. The overnight culture is diluted by a 10 fold factor into YPD media supplemented with 40 mg/l of adenine, and grown for 4 hours at 30° C.

For each mating event, an aliquot of the frozen prey library is grown in 150 ml YAPD medium for 5 hours at 30° C.

Appropriate volumes calculated by measuring the OD600 of each culture are combined into a tube. The number of diploids to be screened is typically ten times the number of clones originally present in the prey library of interest. Assuming a mating efficiency of 20% minimum, fifty times (i.e., ten times coverage multiplied by 20% mating efficiency) as many haploid cells containing the bait and as many cells containing the prey are used in any given mating event. The mixture is filtered over a 47 mm, 0.45 mm sterile Metricel filter membrane (Gelman).

Using sterile forceps, the filter is transferred onto a 100 mm² YAPD agar plate with the cell side up, removing all air bubbles underneath the filter. The plate is incubated overnight at room temperature.

The filter is transferred into a 50 ml Falcon tube using sterile forceps and 10 ml SD medium containing 2% glucose are added to resuspend the cells. The filter, once free of cells, is removed and the cell suspension is spun for 5 min. at 2,000 xg.

The cells are resuspended in 10 ml SD medium containing 2% glucose. An aliquot of 100 µl is set aside for titration.

The cells are plated onto large square plates containing appropriate selective media and incubated at 30° C. for three to five days.

To calculate the mating efficiency and to determine the total number of diploid cells screened, the 100 µl aliquot set aside for titration is diluted and plated onto different selective media. The mating efficiency is calculated by dividing the number of diploids/ml by the lowest number of haploids/ml, either bait or prey, and multiplied by 100. For example, if 2 million diploids were obtained by mating 10 million of haploids containing a bait and 12 million of haploids containing a prey, then the mating efficiency is calculated by dividing 2 million by 10 million, which equals 0.2 and multiplied by 100 which equals 20%. Typical mating efficiencies under the above conditions are within about 20 to about 40%. The total number of diploids screened in a mating event is obtained by multiplying the number of diploids/ml by the total number of ml plated, typically about 10.

Isolation of Colonies Containing Pairs of Interacting Proteins.

Yeast colonies from the interaction selection (large square) plates are picked with a sterile toothpick and patched onto plates containing the appropriate selective media and incubated at 30° C. for two days.

To further ensure purity of the yeast, the plates are replicated onto another plate containing the same media and incubated at 30° C. for another two days.

Yeast patches are scraped using a sterile toothpick and placed into a 96-well format plate containing 100 µl SD -L -W -H with 2% glucose liquid medium.

Half the volume of the plate is transferred to a 96-well plate containing 50 µl of 40% glycerol for storage. The other half is set aside for replication and galactosidase-activity assay (see below).

Cells are replicated onto a SD -L -W -H plate with 2% glucose plate to create a master plate, and incubated two days at 30° C. The master plate is replicated onto different selective media to score the strength of each interaction.

Cells are also replicated onto media selecting for the prey vector only for colony PCR and incubated two days at 30° C.

Galactosidase Activity Assay

Ten microliters from the 96-well plate (set aside from above) are transferred into another 96-well plate containing 100 µl SD and 2% glucose media. The cell-density is measured at $OD_{600}$ using a spectrophotometer, the OD600 is usually between 0.03 and 0.1. Fifty microliters of Galactosidase reaction mixture (Tropix) are added to microplates (Marsh) specifically designed for the luminometer (Hewlett Packard Lumicount). Fifty microliters of the diluted cells are then added and mixed by pipetting. The reaction is incubated sixty to one hundred twenty minutes at room temperature. Relative Light Units (RLUs) are read by the luminometer. Each plate contains a negative control, constituted by diploid yeast containing the bait of interest and an empty prey vector.

To be scored as positive, the diploids tested have to have an RLU number at least twice as high as the negative control.

Example 2

Minimum Interaction Domain Mapping

Further analysis of yeast two hybrid (Y2H) interacting proteins includes the dissection of protein motifs responsible for the interaction. Sequence alignment of multiple clones identified in the Y2H screens can help identify the smallest common region responsible for the interaction. In the absence of appropriate clones, deletion mapping of interacting domains is necessary.

PCR primers containing restriction sites suitable for cloning are designed to cover multiple sub-domains of the protein of interest (bait or prey). The methods involved in cloning, sequencing, yeast transformation, mating, and scoring of interactions are readily performed by one of ordinary skill in the art of molecular biology and genetic engineering.

Materials and Methods

Minimum interaction domain: primers were designed for PCR of the Dkk-1 clone isolated by screening a primary osteoblast cell strain (HOB03C5) library with pooled Zmax1/LRP5 ligand binding domain (LBD) baits: LBD1 (Leu969-Pro1376) and LBD4 (Arg1070-Pro1376). The primers, which are presented in 5' to 3' orientation, were as follows:

| SEQ ID NO | Primer | Sequence |
|---|---|---|
| 155 | Forward 1 | TTTTTTGTCGACCAATTCCAACGCTATCAAG |
| 156 | Forward 2 | TTTTTTGTCGACCTGCGCTAGTCCCACCCGC |
| 157 | Forward 3 | TTTTTTGTCGACCGTGTCTTCTGATCAAAATC |
| 158 | Forward 4 | TTTTTTGTCGACCGGACAAGAAGGTTCTGTTTG |
| 159 | Reverse 1 | TTTTTTGCGGCCGCTTATTTGGTGTGATACATTTTTG |
| 160 | Reverse 2 | TTTTTTGCGGCCGCTTAGCAAGACAGACCTTCTCC |
| 161 | Reverse 3 | TTTTTTGCGGCCGCTTAGTGTCTCTGACAAGTGTG |

PCR was performed using PfuTurbo® polymerase (Stratagene). The PCR products were gel purified, digested with SaflI/NotI and ligated to pPC86 (Gibco/BRL) which had been linearized with SalI/NotI. Clones were recovered and sequenced to ascertain that the structure was as expected and that the Gal4 activation domain and Dkk-1 were in-frame. The ORF of Dkk-1 was Met1-His266, as in human Dkk-1 (GenBank Accession No. XM_005730).

The clones used were as follows: D5 (F1/R3: Asn34-His266), D4 (F1/R2: Asn34-Cys245), D3 (F1/R1: Asn34-Lys182), D9 (F2/R3: Cys97-His266), D12 (F3/R3, val 139-His266), D14 (F4/R3: Gly183-His266), D8 (F2/R2: Cys97-Cys245), and D11 (F3/R2: Val 139-Cys245). F1, F2, F3 and F4 refer respectively to Forward primers 1, 2, 3 and 4. R1, R2 and R3 refer respectively to reverse primers 1, 2 and 3.

These clones were transformed into yeast and mated with each of three yeast strains containing pDBleu (Gibco/BRL), pDBleuLBD1, and pDBleuLBD4. Positive interactions were detected by growth of the hybrids on appropriate selective media.

Results

Minimum interaction domain: FIG. 6 shows that while growth was observed in diploids of D4, D5, D8, D9, and D12, no growth was observed in hybrids of D3, D11, and D12. Carboxy terminal (C-terminal) deletions indicated that while the C-terminal amino acids of Dkk-1 containing the potential N-glycosylation site (Arg246-His266) are not required for interaction with Zmax1/LRP5 LBD baits, the Cys2 domain, Gly183-Cys245, is required. N-terminal deletions also demonstrated that the region between the two cysteine domains, i.e. Val139 to Lys182, is also required. Two minimum interaction domain constructs were isolated: D12 (Val139-His266) and D8 (Cys97-Cys245). Similar constructs could be prepared for Dkk-1 interactors.

Example 3

Yeast-2 Hybrid Screen for Peptide Aptamer Sequences to Dkk-1

Peptide Aptamer Library Construction

A peptide aptamer library, Tpep, was constructed, which provides a means to identify chimeric proteins that bind to a protein target (or bait) of interest using classic yeast two hybrid (Y2H) assays. The Tpep library is a combinatorial aptamer library composed of constrained-random peptides, expressed within the context of the disulfide loop of *E coli* thioredoxin (trxA), and as C-termini fusion to the *S. cerevisiae* Gal4 activation domain. The Tpep library was generated using a restriction enzyme modified recombinant Y2H prey vector, pPC86 (Gibco), which contains the trxA scaffold protein.

Generation of Aptamer-encoding Sequences

Aptamer-encoding sequences were produced as follows. DNA encoding random stretches of approximately sixteen amino acids surrounded by appropriate restriction sites were generated by semi-random oligonucleotide synthesis. The synthetic oligonucleotides were PCR-amplified, restriction digested, and cloned into the permissive sites within the trxA scaffold protein. The cloning strategy was to insert the random oligonucleotide sequence is in-frame with the scaffold protein coding sequence, resulting in expression of a scaffold protein-aptamer chimera. The scaffold protein is itself in-frame with the activation domain of Gal4, within the pPC86 vector that is appropriate for the aptamer to be expressed and functional in a regular Y2H assay. Additional methods of preparing aptamers would be apparent to the skilled artisan.

Generation of a Permissive Recombinant pPC86 Vector Containing the TrxA Coding Sequence First the RsrII restriction site located within the Gal4 activation domain of pPC86 (Gibco) was eliminated by site-directed mutagenesis (Quickchange™ kit, Stratagene). The amino acid sequence of the Gal4 activation domain was unchanged by this modification. The strength of different control interactions was verified to be unchanged by the modification.

Second, the *E. coli* trxA coding sequence was cloned into the SalI and NotI sites of the RsrII-modified pPC86. EcoRI and SpeI sites were then introduced within the trxA RsrII site.

The oligonucleotides encoding the peptide aptamers were cloned into the EcoRI and SpeI sites of the resulting vector.

Example 4

Yeast-2 Hybrid Screen for Dkk-1 Interacting Proteins

A Dkk-1 bait sequence was utilized in a yeast two hybrid screen to identify Dkk-1 interacting proteins. The procedure for the Y2H was carried out similarly to that employed in Example 1, except that the Dkk-1 bait from FIG. 2C was used instead of LRP baits. The screen was performed using Hela and fetal brain libraries (Invitrogen Corporation, Carlsbad, Calif.). Multiple libraries were used to identify additional Dkk-1 interacting proteins and to confirm interactions found in other libraries.

The list of Dkk-1 interacting proteins uncovered in these Y2H screens are listed in FIG. 5.

The interacting proteins identified in the Dkk-1 bait screen can be used in other Y2H screens with LRP baits and other Dkk-1 interacting proteins to determine more complex interactions which may modulate Dkk-1/LRP interactions and/or Wnt signaling.

Example 5

Generation of Antibodies

In each of the following antibody-generating examples, the synthesis of these linear peptides is followed by injection into two New Zealand Rabbits. Subsequent boosts and bleeds are taken according to a standard ten-week protocol. The end-user receives back 5 mgs of peptide, aliquots of pre-bleeds, roughly 80 ml of crude sera from each of the two rabbits and, and ELISA titration data is obtained.

Generation of LRP5 Polymorphism-specific Antibodies

Antibodies were generated to the following peptides to obtain antibodies which distinguish the HBM polymorphism versus wild-type LRP5/Zmax: MYWFDWVETPRIE (SEQ ID NO:123) (mutant peptide) and MYWTDWGETPRIE (SEQ ID NO:124) (wild-type peptide for negative selection). Immunofluorescence data confirmed that the antibody, after affinity purification, is specific for HBM and does not recognize LRP5 (FIG. 17).

Generation of LRP5 Monospecific Antibodies

LRP5 monospecific polyclonal antibodies were generated to the following amino acid sequences of LRP5: Peptide 1 (a.a. 265-277)—KRTGGKRKEILSA (SEQ ID NO:125), Peptide 2 (a.a. 1178-1194) — ERVEKTTGDKRTRIQGR (SEQ ID NO:126), and Peptide 3 (a.a. 1352-1375) — KQQCDSFPDCIDGSDE (SEQ ID NO:127). Immunofluorescence confirmed that the antibody generated detects LRP5.

Generation of Dkk-1 Monospecific Polyclonal Antibodies

Dkk-1 monospecific polyclonal antibodies were generated to the following amino acid sequences of Dkk-1: Peptide 1 (a.a. 71-85)—GNKYQTIDNYQPYPC (SEQ ID NO:118), Peptide 2 (a.a. 165-186)— LDGYSRRTTLSSKMYHT-KGQEG (SEQ ID NO:119), Peptide 3 (a.a. 246-266)—RIQKDHHQASNSSRLHTCQRH (SEQ ID NO:120), Peptide 4 (a.a. 147-161)—RGEIEETITESFGND (SEQ ID NO:121), and Peptide 5 (232-250)—EIFQRCY-CGEGLSCRIQKD (SEQ ID NO:122) of human Dkk-1. FIG. 26 shows the location of the various peptides selected, their relationship to the Dkk-1 amino acid sequence and polyclonal antibodies generated.

Western blots demonstrated that the antibodies generated against peptides 2 (Antibody #5521) (FIG. 27) and 4 (Antibody #74397) (FIG. 28) are specific toward Dkk-1. FIG. 27 shows Western blots using 500 μl of conditioned medium (CM) from non-transfected 293 cells or from 293 cells transfected with Dkk1-V5 that were immunoprecipitated by anti-V5 antibody. Bead elutes were separated by non-reducing SDS-PAGE (lanes #4, 5 of FIG. 27). 20 μl of conditioned medium from both samples (lanes #2,3 of FIG. 27) and from Dkk1-AP transfected 293 cells (lane #6 of Figure 27) were additionally separated on the gel. The Western was performed using antibodies Anti-V5/AP (1:10,000) and Ab#5521 (10 μg/ml). Ab#5521 detected Dkk1-V5 and Dkk1-AP from conditioned medium.

FIG. 28 shows Western blot results using Ab#74397. Anti-V5/AP was tested at a 1:4000 dilution and Ab#74397 was tested at a 1:500 dilution. Ab#74397 was able to detect Dkk1-V5 in both conditioned medium and immunoprecipitated conditioned medium.

The results obtained with antibodies #5521 and #74397 are summarized in the following table:

| Rabbit No. | Peptide Position | Peptide Sequence | Purified (Y/N) | Western | Immuno-precipitation | Location |
| --- | --- | --- | --- | --- | --- | --- |
| 5521 | 165-186 | LDGYSRRTTLSSKMYHTKGQEG | Y (Protein G purified) | Y | N/A | Between Cy1 and Cys2 domain |
| 74397 | 147-161 | RGEIEETITESFGND | N | Y | N/A | Between Cy1 and Cys2 domain |

Example 6

Effects of Exogenous Dkk-1 on Wnt-mediated Signaling in the *Xenopus* Embryo Assay

*Xenopus* embryos are an informative and well-established in vivo assay system to evaluate the modulation of Wnt signaling (McMahon et al., *Cell* 58: 1075-84 (1989); Smith and Harland, 1991 reviewed in Wodarz and Nusse 1998).

Modification of the Wnt signaling pathway can be visualized by examining the embryos for a dorsalization phenotype (duplicated body axis) after RNA injection into the ventral blastomere at the 4- or 8-cell stage. On the molecular level, phenotypes can be analyzed by looking for expression of various marker genes in stage 10.5 embryos. Such markers would include general endoderm, mesoderm, and ectoderm markers as well as a variety of tissue-specific transcripts.

Analysis can be done by RT-PCR/TaqMan® and can be done on whole embryo tissue or in a more restricted fashion (microdissection). Because this system is very flexible and rapid, by injecting combinations of transcripts, such as HBM and different Wnts or Wnt antagonists, the mechanism of HBM in the Wnt pathway can thereby be dissected. Furthermore, investigations are conducted to determine whether Zmax/LRP5 and HBM differentially modulate Wnt signaling either alone, or in combination with other components. Previous studies have demonstrated that LRP6 alone or LRP5 + Wnt5a were able to induce axis duplication (dorsalization) in this system (Tamai et al., Nature 407:530-35 (2000)).

Constructs for *Xenopus* Expression (Vector pCS2+)

Constructs were prepared using the vector pCS2+. DNA inserts were subcloned in the sense orientation with respect to the vector SP6 promoter. The pCS2$^{30}$ vector contains an SV40 virus polyadenylation signal and T3 promoter sequence (for generation of antisense mRNA) downstream of the insert.

Full length Zmax/LRP5 and HBM ORF cDNA: Insert cDNA was isolated from the full length cDNA retrovirus constructs (with optimized Kozak sequences) by Bg/II-EcoRI digestion and subcloned into the BamHI-EcoRI sites of the pCS2+ vector.

Full length XWnt8: This cDNA was PCR amplified from a *Xenopus* embryo cDNA library using oligos 114484 (SEQ ID NO:162) (5'-CAGTGAATTCACCATGCAAAACAC-CACTTTGTTC-3') and 114487 (SEQ ID NO:163) (5'-CAGTTGCGGCCGCTCATCTCCGGTGGCCTCTG-3'). The oligos were designed to amplify the ORF with a consensus Kozak sequence at the 5' end as determined from GenBank #X57234. PCR was carried out using the following conditions: 96° C., 45 sec.; 63° C., 45 sec.; 72° C., 2 min. for 30 cycles. The resulting PCR product was purified, subcloned into pCRII-TOPO (Invitrogen Corp.), sequence verified, and digested with BamHI/XhoI. This insert was subcloned into the vector at the BamHI-XhoI sites.

Full length Wnt5a: A murine Wnt5a cDNA clone was purchased from Upstate Biotechnology (Lake Placid, N.Y.) and subcloned into the EcoRI site of the vector. Sequencing confirmed insert orientation.

Full length human Dkk-1: A human CDNA with GenBank accession number AF127563 was available in the public database. Using this sequence, PCR primers were designed to amplify the open reading frame with a consensus Kozak sequence immediately upstream of the initiating ATG. Oligos 117162 (SEQ ID NO:164) (5'-CMTAGTCGACGAAT-TCACCATGGCTCTGGGCGCAGCGG-3') and 117163 (SEQ ID NO:165) (5'-GTATTGCGGCCGCTCTAGATT-AGTGTCTCTGACAAGTGTGAA-3') were used to screen a human uterus CDNA library by PCR. The resulting PCR product was purified, subcloned into PCRII-TOPO (Invitrogen Corp.), sequence verified, and digested with EcoRI/XhoI. This insert was subcloned into the pCS2+ vector at the EcoRI-XhoI sites.

Full length human Dkk-2: A full length cDNA encoding human Dkk-2 was isolated to investigate the specificity of the Zmax/LRP5/HBM interaction with the Dkk family of molecules. Dkk-1 was identified in yeast as a potential binding partner of Zmax/LRP5/HBM. Dkk-1 has also been shown in the literature to be an antagonist of the Wnt signaling pathway, while Dkk-2 is not (Krupnik et al., 1999). The Dkk-2 full length cDNA serves as a tool to discriminate the specificity and biological significance of Zmax/LRP5/HBM interactions with the Dkk family (e.g., Dkk-1, Dkk-2, Dkk-3, Dkk-4, Soggy, their homologs and variant, etc.). A human cDNA sequence for Dkk-2 (GenBank Accession No. NM_014421) was available in the public database. Using this sequence, PCR primers were-designed to amplify the open reading frame with a consensus Kozak sequence immediately upstream of the initiating ATG. Oligos 51409 (SEQ ID NO:166) (5'-CTMCGGATCCACCATGGCCGCGTTGAT-GCGG-3') and 51411(SEQ ID NO:167) (5'-GATTCGAAT-TCTCAAATTTTCTGACACACATGG-3') were used to screen human embryo and brain cDNA libraries by PCR. The resulting PCR product was purified, subcloned into pCRII-TOPO, sequence verified, and digested with BamHI/EcoRI. This insert was subcloned into the pCS2+ vector at the BamHI-EcoRI sites.

Full length LRP6 was isolated from the pED6dpc4 vector by XhoI-XbaI digestion. The full length cDNA was reassembled into the XhoI-XbaI sites of pCS2+. Insert orientation was confirmed by DNA sequencing.

mRNA Synthesis and Microinjection Protocol mRNA for microinjection into *Xenopus* embryos is generated by in vitro transcription using the CDNA constructs in the pCS2+ vector described above as template. RNA is synthesized using the Ambion mMessage mMachine high yield capped RNA transcription kit (Cat. #1340) following the manufacturer's specifications for the Sp6 polymerase reactions. RNA products were brought up to a final volume of 50 µl in sterile, glass-distilled water and purified over Quick Spin-Columns for Radiolabelled RNA Purification G50-Sephadex (Roche, Cat. #1274015) following the manufacturer's specifications. The resulting eluate was finally extracted with phenol:chloroform:isoamyl alcohol and isopropanol precipitated using standard protocols (Sambrook et al., 1989). Final RNA volumes were approximately 50 µl. RNA concentration was determined by absorbance values at 260 nm and 280 nm. RNA integrity was visualized by ethidium bromide staining of denaturing (formaldehyde) agarose gel electrophoresis (Sambrook et al., 1989). Various amounts of RNA (2 pg to 1 ng) are injected into the ventral blastomere of the 4- or 8-cell *Xenopus* embryo. These protocols are described in Moon et al., *Technique-J. of Methods in Cell and Mol. Biol.* 1: 76-89 (1989), and Peng, *Meth. Cell. Biol.* 36: 657-62 (1991).

Screening for Duplicated Body Axis

In vitro transcribed RNA is purified and injected into a ventral blasomere of the 4-or 8-cell *Xenopus* embryo (approx. 2 hours post-fertilization). At stage 10.5 (approx. 11hours post-fertilizaton), the injected embryos are cultured for a total of 72 hours and then screened for the presence of a duplicated body axis (dorsalization) (FIG. 7). Using XWnt8-injected (2-10 pg) as a positive control (Christian et al. (1991)) and water-injected or non-injected embryos as negative controls, we replicated the published observation that Zmax(LRP5)+Wnt5a (500 and 20 pg, respectively) could induce axis duplication. Wnt5a (20 pg) alone could not induce axis duplication (as previously reported by Moon et al. (1993)). We have also injected GFP RNA (100-770 pg) as a negative control to show that the amount of RNA injected is not perturbing embryo development (not shown). Strikingly, HBM+Wnt5a (500 and 20 pg, respectively) yielded an approximately 3.5 fold more robust response of the phenotype (p=0.043 by Fisher's exact test) compared to Zmax(LRP5)+Wnt5a, suggesting that the HBM mutation is activating the Wnt pathway (FIGS. 8 and 9). The HBM/Wnt5a embryos also appear to be more "anteriorized" than the Zmax(LRP5)/Wnt5a embryos, again suggestive of a gain-of-function mutation.

The role of Dkk-1 as a modulator of Zmax/LRP5- and HBM-mediated Wnt signaling was investigated. Literature reports have previously characterized *Xenopus* and murine Dkk-1 as antagonists of the canonical Wnt pathway in the *Xenopus* system (Glinka et al., Nature 391:357-362 (1998)). Using the human Dkk-1 construct, a dose-response assay was performed to confirm that our construct was functional and to identify the optimal amount of RNA for microinjection. Using 250 pg/embryo of hDkk-1RNA, over 90% (p<0.001) of the embryos were observed to display enlarged anterior structures (big heads) as anticipated from the published reports (FIG. 10).

The mechanism of hDkk-1 modulation of Wnt signaling in the presence of Zmax/LRP5 or HBM was also investigated. Without any hDkk-1 present, it was confirmed that HBM+Wnt5a was a more potent activator of Wnt signaling than Zmax/LRP5+Wnt5a (p<0.05). Interestingly, in the presence of hDkk-1 (250 pg), Zmax/LRP5-mediated Wnt signaling was repressed (p<0.05) but hDkk-1 was unable to repress HBM-mediated Wnt signaling (p<0.01) (FIG. 11). The specificity of this observation can be further addressed by investigating other members of the Dkk family, other Wnt genes, LRP6, additional Zmax/LRP5 mutants, and the peptide aptamers.

Example 7

Effects of Exogenous Dkk and LRP5 on Wnt Signaling in the TCF-luciferase Assay

Wnt-activity can be antagonized by many proteins including secreted Frizzled related proteins (SFRPs), Cerberus, Wnt Inhibitory Factor-1 and Dkk-1 (Krupnik et al., 1999). The Dkk family of proteins consists of Dkk-1-4 and Soggy, a Dkk-3-like protein. Dkk-1 and Dkk4 have been shown to antagonize Wnt mediated *Xenopus* embryo development, whereas Dkk-2, Dkk-3, and Soggy do not. Unlike many of these proteins that antagonize Wnt activity by directly interacting with Wnt proteins, Dkk-1 acts by binding to two recently identified Wnt coreceptors, LRP5 and LRP6. (Mao et al., 2001; Bafico et al., 2001). The details of this interaction have been examined by the present inventors and Mao et al. using deletion constructs of LRP6, which demonstrated that EGF repeats 3 and 4 are important for Dkk-1 interaction. Accordingly, the activity of two Dkk proteins, Dkk-1 and Dkk-2, were investigated with various Wnt members, LRP5, LRP6, and the mutant form of LRP5, designated HBM. The present invention explores whether there is any functional difference between LRP5 and HBM with regard to Dkk action on Wnt mediated signaling. Various reagents were developed, including Dkk-1 peptides, constrained LRP5 peptide aptamers, constrained Dkk-1 peptide aptamers and polyclonal antibodies to Dkk-1 (in Example 5 above) to identify factors that mimic HBM mediated Wnt signaling.

Methods

Various LRP5 constrained peptides were developed. Specifically, four peptides that interact with the LBD of LRP5 (FIG. 4, constructs OST259-262 in FIG. 12) and three peptides that interact with the cytoplasmic domain of LRP5 (constructs OST266-OST268 in FIG. 12). In addition two Dkk-1 peptides were developed: constructs OST264 and OST265 in FIG. 12, corresponding to Dkk-1 amino acids 139-266 and 96-245, containing the smallest region of Dkk-1 that interacts with LRP5 (FIG. 6). The cDNA clones encoding the LRP5 LBD interacting peptides and the Dkk-1 peptides were subcloned into pcDNA3.1 with the addition of a Kozak-and signal sequence to target the peptide for secretion. The constructs encoding the three peptides interacting with the cytoplasmic domain of LRP5 were also subcloned into pcDNA3.1. However, these latter constructs do not contain a signal sequence.

HOB-03-CE6 osteoblastic cells developed by Wyeth Ayerst (Philadelphia, Pa.) were seeded into 24-well plates at 150,000 cells per well in 1 ml of the growth media (D-MEM/F12 phenol red-free) containing 10% (v/v) heat-inactivated FBS, 1×penicillin streptomycin, and 1X Glutamax-1, and incubated overnight at 34° C. The following day, the cells were transfected using Lipofectamine 2000® (as described by the manufacturer, Invitrogen) in OptiMEM (Invitrogen) with 0.35 µg/well of LRP5, HBM, or control plasmid DNA (empty vector pcDNA3.1) and either Wnt1 or Wnt3 a plasmid DNA. Similar experiments were performed with LRP6 plasmid DNA (0.35 µg/well) or a control pEDdpc4 empty vector. Furthermore, each of these groups were then divided into three groups, those receiving 0.35 µg/well Dkk-1, Dkk-2, or pcDNA3.1 control DNA. All wells were transfected with 0.025 µg/well of CMV beta-galactosidase plasmid DNA and 0.35 µg/well 16X TCF(ASyluciferase reporter DNA (developed by Ramesh Bhat, Wyeth-Ayerst (Philadelphia, Pa.)). After 4 hours of incubation, the cells were rinsed and 1 ml of fresh growth media was added to each well. The cells were cultured overnight at 34° C., followed by a wash and a change of media. Cells were cultured for an additional 18-24 hours at 37° C. Cells were then lysed with 50 µl/well of 1X lysis buffer. The extracts were assayed for beta-galactosidase activity (Galacto Reaction Buffer Diluent & Light Emission Accelerator, Tropix) using 5 µl extract+50 µl beta-galactosidase diluent and luciferase activity (Luciferase Assay Reagent, Promega) using 20 µl extract.

U2OS human osteosarcoma cells were also utilized. U2OS cells (ATCC) were seeded into 96-well plates at 30,000 cells per well in 200 ul of the growth media (McCoy's 5A) containing 10% (v/v) heat-inactivated FBS, 1X penicillin streptomycin, and 1×Glutamax-1, and incubated overnight at 37° C. The following day, the media was replaced with OptiMEM (Invitroge) and cells were transfected using Lipofectamine 20000® (as described by the manufacturer, Invitrogen) with. 0.005 µg/well of LRP5, HBM, LRP6 or contol plasmid DNA (empty vector pcDNA3.1) and either Wnt1 (0.0025 ug/well) or Wnt3a (0.0025 ug/well) plasmid DNA. In addition, the 16x-(AS) TCF-TK-firefly-luciferase (Ramesh Bhat, WHRI, Wyeth) and control TK-renilla luciferase (Promega Corp.) were co-transfected at 0.3 ug/well and 0.06 ug/well respectively in all experiments. Futhermore, each of these groups was then divided into different groups, those receiving 0.05 ug/well Dkk-1, Dkk-2, Dkk3, Dkk1-Alkaline Phosphatase (AP), mutant Dkk-1 (C220A), Soggy or pcDNA3.1 control DNA. In other experiments, cells were co-transfected with 0.005 µg/well of LRP5, 0.0025 ug/well of Wnt1 or Wnt3 a (using 0.0025 pg/well of a control pcDNA3.1) with LRP5-interacting aptamers (0.05 ug/well). Cells were cultured for an additional 18-20 hours at 37° C. Culture medium was removed. Cells were cultured for an additional 18-20 hours at 37° C. Culture medium was removed. Cells were then lysed with 100 µl/well of 1X Passive Lysis Buffer (PLB) of Dual Luciferase Reagent kit (DLR-kit-Promega Corp.) 20 µl of the lysates were combined with LARII reagent of DLR-kit and assayed for TCF-firefly luciferase signal in Top Count (Packard) instrument. After measuring the Firefly readings, 100 µl of the "Stop and Glo" reagent of DLR kit that contains a quencher and a substrate for renilla luciferase was added into each well. Immediately the renilla luciferase reading was measured using the Top Count (Packard) Instrument. The ratios of the TCF-firefly luciferase to control renilla readings were calculated for each well and the mean ratio of triplicate or more wells was expressed in all data.

Results

The results of these experiments demonstrate that Dkk-1, in the presence of Wnt1 and LRP5, significantly antagonized TCF-luciferase activity (FIG. 14). In marked contrast, Dkk-1 had no effect on HBM/Wnt1 mediated TCF-luciferase activity (FIG. 14). In similar experiments, Dkk-1 was also able to antagonize LRP5/Wnt3a but not HBM/Wnt3a mediated TCF-luciferase activity (FIG. 15). These results indicate that the HBM mutation renders Dkk-1 inactive as an antagonist of Wnt1 and Wnt3a signaling in HOB03CE6 osteoblastic cells. In other experiments with Wnt1, Dkk-1 had no effect on LRP5 or HBM mediated TCF-luciferase activity (FIG. 14). In contrast, with either LRP5 or HBM in the presence of Wnt3a, Dkk-2 was able to antagonize the TCF-luciferase activity (FIG. 15). These latter results indicate that the HBM mutation has no effect on Dkk-2 action in the presence of Wnt3a. Experiments were also performed using the closely related LRP6 cDNA in HOB-03-CE6 cells. In these experiments, LRP6/Wnt1 and LRP6/Wnt3a mediated TCF-luciferase were regulated in the same manner as LRP5. Specifically, Dkk-1 antagonized LRP6/nt1 mediated TCF-luciferase activity, whereas Dkk-2 had no effect (FIG. 14). However, similar to the action of Dkk-2 with LRP5/Wnt3a, Dkk-2 was able to antagonize LRP6/Wnt3a mediated TCF-luciferase activity (FIG. 15).

The results in the U2OS cells show a robust effect of the OST262 LRP5 peptide aptamer activation of Wnt signaling in the presence of Wnt3a (FIG. 16). These functional results are confirmed by the results shown below in Example 11 using LRP5 peptide aptamers in the *Xenopus* assay. Such results affirmatively demonstrate that the effects of small molecules on LRP5/LRP6/HBM signaling can be detected using the TCF-luciferase assay.

These data demonstrate that there is a functional difference between LRP5 and HBM regarding the ability of Dkk-1 to antagonize Wnt1 and Wnt3a signaling. These data and previous data showing that Dkk-1 directly interacts with LRP5 suggests that the inability of Dkk-1 to antagonize HBM/Wnt signaling may in part contribute to the HBM phenotype. These experiments further demonstrate the ability to test various molecules (e.g., small molecules, aptamers, peptides, antibodies, LRP5 interacting proteins or Dkk-1 interacting proteins, and the like) for a LRP5 ligand that mimics HBM mediated Wnt signaling or factors that block Dkk-1 interaction with LRP5.

Example 8

Yeast-2 Hybrid Interaction Trap

Small molecule inhibitors (or partial inhibitors) of the Dkk-LRP interaction may be an excellent osteogenic therapeutic. One way to investigate this important protein-protein interaction is using Y2H techniques substantially as described above and as is well known in the art. Regions of LRP5, such as LRP5 LBD, have been found to functionally interact with Dkk. This interaction is quantitated using a reporter element known in the art, e.g., LacZ or luciferase, which is only activated when bait and prey interact. The Y2H assay is used to screen for compounds which modulate the LRP-Dkk interaction. Such a modulation would be visualized by a reduction in reporter element activation signifying a weaker or disrupted interaction, or by an enhancement of the reporter element activation signifying a stronger interaction. Thus, the Y2H assay can be used as a high-throughput screening technique to identify compounds which disrupt or enhance Dkk interaction with LRP5/LRP6/HBM, which may serve as potential therapeutics.

For example, the Interaction Trap methodology can be used as follows. The LRP5 LBD, for example, was fused with LexA and Dkk-1 was fused with either Gal4-AD or B42. With the LRP5LBD-LexA bait and the Gal4AD-Dkk prey, over a 20-fold activation of a lacZ reporter (under the control of a single LexA operator) was detected over the background. Using a Dkk-1 mutant (C220A) that is unable to bind to LRP, the interaction was reduced in yeast, showing the specificity of this interaction and system (FIG. 18). As a result, small molecules may be identified that modulate this interaction between LRP and Dkk.

Example 9

Cell-Based Functional High-Throughput Assay

To develop a high throughput assay, the TCF-luciferase assay described in Example 7 was modified utilizing low level expression of endogenous LRP5/6 in U2OS and HEK293 cells. However, HOB-03-CE6 cells and any other cells which show a differential response to Dkk depending on whether LRP5, LRP6 or HBM are expressed. Using U2OS (human osteosarcoma) and HEK293 (ATCC) cells, the TCF-luciferase and tk-Renilla reporter element constructs were co-transfected along with Wnt3a/1 and Dkk. Wnt3a alone, by using endogenous LRP5/6, was able to stimulate TCF reporter gene activation. When Dkk, is co-transfected with Wnt3a/Wnt 1 and reporters (TCF-luci and tk-Renilla), DEkk represses reporter element activity. In addition, the TCF-luci signal is activated by Wnt3a/Wnt1 can be repressed by the addition of Dkk-enriched conditioned media to the cells containing Wnt3a/Wnt1 and reporters. The assay is further validated by the lack of TCF-reporter inhibition by a point mutant construct (C220A) of Dkk1.

The Dkk-mediated repression of the reporter is dependent upon the concentration of transfected Dkk cDNA or on the amount of Dkk-conditioned media added. In addition, the Dkk-mediated reporter suppression can be altered by the co-transfection of LRP5, LRP6, and HBM cDNAs in the U2OS or HEK293 cells. In general, U2OS cells show greater sensitivity to Dkk-mediated reporter suppression than that in HEK-293 cells. In U2OS cells, the transfection of LRP5/LRP6/HBM cDNA leads to moderate activation of TCF-luci in the absence of Wnt3a/Wnt1 transfection. This activation presumably utilizes the endogenous Wnts present in U2OS cells. Under this condition, Dkk1 can repress TCF-luci and shows a differential signal between LRP5 and HBM. By co-transfecting Wnt3a/Wnt1, there is a generalized increase in the TCF-luci signal in the assay. Further, one can detect Dkk-mediated differential repression of the reporter due to LRP5 and HBM CDNA expression as well as between LRP5 and LRP6 cDNA. The repression is maximal with LRP6, moderate with LRP5, and least with HBM cDNA expression. In addition, the assay can detect the functional impact of the LRP5 interacting peptide aptamers (FIG. 4), Dkk1 interacting aptamers and binding domains of Dkk-1 (FIG. 6; OST264 and OST265 of FIGS. 12 and 13).

Using this system with a-suppressed Wnt-TCF signal due to the presence of both Dkk and Wnt3a, one can screen for compounds that could alter Dkk modulation of Wnt signaling, by looking for compounds that activate or the TCF-luciferase reporter, and thereby relieve the Dkk-mediated repression of the Wnt pathway. Such compounds identified may potentially serve as HBM-mimetics and be useful, for example, as osteogenic therapeutics. Data generated from this high throughput screen are demonstrated in FIGS. 19-21. FIG. 19 shows that Dkk1 represses Wnt3a-mediated signaling in U2OS bone cells. FIG. 20 demonstrates the functional differences between LRP5, LRP6, and HBM. Dkk-1 represses LRP6 and LRP5 but has little or no effect on HBM-genera ted Wnt1 signaling in U2OS cells. FIG. 21 demonstrates the differential effects of various Dkk family members and modified Dkks, including Dkk-1, a mutated Dkk-1 (C220A), Dkk-1-AP (modified with alkaline phosphatase), Dkk-3, and Soggy.

Example 10

DKK/LRP5/6/HBM ELISA Assay

A further method to investigate Dkk binding to LRP is via ELISA assay. Two possible permutations of this assay are exemplified. LRP5 is immobilized to a solid surface, such-as a tissue culture plate well. One skilled in the art will recognize that other supports such as a nylon or nitrocellulose membrane, a silicon chip, a glass slide, beads, etc. can be utilized. In this example, the form of LRP5 used is actually a fusion protein where the extracellular domain of LRP5 is fused to the Fc portion of human IgG. The LRP5-Fc fusion protein is produced in CHO cell extracts from stable cell lines. The LRP5-Fc fusion protein is immobilized on the solid surface via anti-human Fc antibody or by Protein-A or Protein G-coated plates, for example. The plate is then washed to remove any non-bound protein. Conditioned media containing secreted Dkk protein or secreted Dkk-epitope tagged protein (or purified Dkk or purified Dkk-epitope tagged protein) is incubated in the wells and binding of Dkk to LRP is investigated using antibodies to either Dkk-or to an epitope tag. Dkk-V5 epitope tagged protein would be detected using an alkaline phosphatase tagged anti-V5 antibody.

Alternatively, the Dkk protein could be directly fused to a detection marker, such as alkaline phosphatase. Here the detection of the Dkk-LRP interaction can be directly investigated without subsequent antibody-based experiments. The bound Dkk is detected in an alkaline phosphatase assay. If the Dkk-alkaline phosphatase fusion protein is bound to the immobilized LRP5, alkaline phosphatase activity would be detected in a calorimetric readout. As a result, one can assay the ability of small molecule compounds to alter the binding of Dkk to LRP using this system. Compounds, when added with Dkk (or epitope-tagged Dkk) to each well of the plate, can be scored for their ability to modulate the interaction between Dkk and LRP based on the signal intensity of bound Dkk present in the well after a suitable incubation time and washing. The assay can be calibrated by doing cold competition experiments with unlabeled Dkk or with a second type of epitope-tagged Dkk. Any small molecule that is able to modulate the Dkk-LRP interaction may be a suitable therapeutic candidate, more preferably an osteogenic therapeutic candidate.

Example 11

Functional Evaluation of Peptide Aptamers in *Xenopus*

The constrained peptide aptamers constructs OST258-263 (where 258 contains the signal sequence by itself and 263 contains an irrelevant constrained peptide) (FIGS. 12 and 13) were used to generate RNA substantially as described in Example 7, except the vector was linearized by restriction endonuclease digestion and RNA was generated using T7 RNA polymerase.

Aptamer RNA was injected at 250 pg per blastomere using the protocol of Example 7. Wnt signaling was activated, as visualized by embryo dorsalization (duplicated body axis) with aptamers 261 and, more strongly, 262. The results of this assay are shown in FIGS. 22 and 23. These results suggest that aptamers 261 and 262 are able to activate Wnt signaling possibly by binding to the LBD of LRP, thereby preventing the modulation of LRP-mediated signaling by Dkk.

The aptamers of the present invention can serve as HBM-mimetics. In the *Xenopus* system they are able to induce Wnt signaling all by themselves. They may also serve as tools for rational drug design by enhancing the understanding of how peptides are able to interact with LRP and modulate Wnt signaling at the specific amino acid level. Thus, one would be able to design small molecules to mimic their effects as therapeutics. In addition, the aptamers identified as positives in this assay may be used as therapeutic molecules themselves.

Example 12

Homogenous Assay

An excellent method to investigate perturbations in protein-protein interactions is via Fluorescence Resonance Energy Transfer (FRET). FRET is a quantum, mechanical process where a fluorescent molecule, the donor, transfers energy to an acceptor chromophore molecule which is in close proximity. This system has been successfully used in the literature to characterize the intermolecular interactions between LRP5 and Axin (Mao et al., *Molec. Cell Biol.* 7:801-809). There are many different fluorescent tags available for such studies and there are several ways to fluorescently tag the proteins of interest. For example, CFP (cyan fluorescent protein) and YFP (yellow fluorescent protein) can be used as donor and acceptor, respectively. Fusion proteins, with a donor and an acceptor, can be engineered, expressed, and purified.

For instance, purified LRP protein, or portions or domains thereof, fused to CFP and purified Dkk protein, or portions or domains thereof that interact with Dkk or LRP respectively, fused to YFP can be generated and purified using standard aproaches. If LRP-CFP and Dkk-YFP are in close proximity, the transfer of energy from CFP to YFP will result in a reduction of CFP emission and an increase in YFP emission. Energy is supplied with an excitation wavelength of 450 nm and the energy transfer is recorded at emission wavelengths of 480 nm and 570 nm. The ratio of YFP emission to CFP emission provides a guage for changes in the interaction between LRP and Dkk. This system is amenable for screening small molecule compounds that may alter the Dkk-LRP protein-protein interaction. Compounds that disrupt the interaction would be identified by a decrease in the ratio of YFP emission to CFP emission. Such compounds that modulate the LRP-Dkk interaction would then be considered candidate HBM mimetic molecules. Further characterization of the compounds can be done using the TCF-luciferase or *Xenopus* embryo assays to elucidate the effects of the compounds on Wnt signaling.

While the above example describes a cell-fee, solution-phase assay using purified components, a similar cell-based assay could also be performed. For example, LRP-CFP fusion protein can be expressed in cells. The Dkk-YFP fusion protein then could be added to the cells either as purified protein or as conditioned media. The interaction of LRP and Dkk is then monitored as described above.

All references cited herein are hereby incorporated by reference in their entirety for all purposes. The following applications are also incorporated by reference in their entirety herein for all purposes: U.S. application Ser. No. 60/290,071, filed May 11, 2001; U.S. application Ser. No. 09/544,398, filed on Apr. 5, 2000; U.S. application Ser. No. 09/543,771, filed Apr. 5, 2000; U.S. application Ser. 09/578,900; U.S. application Ser. No. 09/229,319, filed Jan. 13,1999; U.S. Provisional Application 60/071,449, filed Jan. 13, 1998; and International Application PCT/US00/16951, filed Jun. 21, 2000; International PCT Application entitled "HBM Variants That Modulate Bone Mass and Lipid Levels," filed May 13, 2002; and International PCT Application entitled "Transgenic Animal Model of Bone Mass Modulation," filed May 13, 2002. Additionally, this application claims priority to U.S. provisional applications Ser. No. 60/291,311, filed May 17, 2001; U.S. application Ser. No. 60/353,058, filed Feb. 1, 2002; and U.S. application Ser. No. 60/361,293, filed Mar. 4, 2002; the texts of which are herein incorporated by reference in their entirety for all purposes.

SEQUENCE LISTING (216 sequences)

SEQ ID NO: 1 - DNA, 5120 bp, Homo sapiens
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 2 - DNA, 5120 bp, Homo sapiens
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactgggttgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 3 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPKAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGWSHLCLLSPSEPFYTCACPTGVQMQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKNISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEVDCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 4 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPKAIALDPAHGYMYWTDWVETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGWSHLCLLSPSEPFYTCACPTGVQMQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKNISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEVDCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 5 - DNA, 3096 bp, Homo sapiens
catcttctcacacgatctctcgcttcgcactccttcctttgattggttttcaccatttactcagacgacggtccttcttcgatctttgcacattcttctatcatctactaccttcatacccagctccgtcccctaatattcatgcgcggatggcccattccgtggtgaaaattcccttctactctgctaatctgctgttctctctccctcccgtcgggttctgctcctgccacgttctcccctctccccaccaaaggctgggttttctttgtcagggctcctttcccctttggaagaaggggggctgtatggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgcccagttccttccaaaggaaagccagctccccaggtggtgggagagtgatatggcttcctcttaaacttagggaattgagtgtgtggttgcttctaagtgccttagaagccgggagcggctcctggaaagagcctgcctgccacagcgggccttaccctggctgtgcccacagatgtccctggggcctgccgctcctgcccggctctcctggcctcccccggtgtgggttgggaaaagcacagcaaattaaaaaacacctccatctctggcctttgaagaatgcatctgaacagccgagagtgtaaaccgtggtgaaatgtggtctttccagtttggggagaagcagggcagagctggggcttttgtacccagggtttccaagagctcctgcctccctcggctgggctggccagggccccccgctgggacctccagctgtaatagggaaggttttactgggttgctggccactgtggactgcccctaagggcaggtatgcctgcctttacccgggttcccctcctgcctggaagatacagcccatgggaggcctgttgtctgtgggatcctccagcatcagagacactggggccagcgtctgcctggtgaggtgcaggcctggcaggcccggtcccccacctgcttgagcacccacggtggtgggggctcgctgcctcccgagacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacctgggctcctccctcactgagtggagggaactcagtgtcttggagttggggtgcctgcaggctgggtggtgcaggtgaaatgcagacctctcagctggtgttccagagcagctgccttcccccgcccgagggacttcacccgcagcccagtcaggggtggcgcctgggtgcatcgcccgcaggctgggtaggggtggagcctgggtggccctgcctgtgagctgcatagttgtcgcctttgaccctgagttttcttcgttatctgtttggacctgtttggggcaggcaggggatgagatctgaagataaatgccttagctgtgaccatctccttttgtgagaggtcaatgtccagttccgctgcagttataacatcccattttttgatttctttttattttttcctttttctttttgagatggagtctcgctctgtcacccaggctggagtgcaatggggtgacctcagctcactgcaacctccacttctcgggttcaagtgattctcctgcctcagcctcctgactagcaggggttacaggcgtgagccaccacgcccagctaatttttgtatttttagtagaggcaaggtttcgtcatgttggccaggctggtctcaaactcctggccttaagtgatctgcccgcctcggcctcccaaagtgctgagatgacaggtgtgagccaccgtgcccggcccagaactctttaattcccacctgaaacttgccgccttaagcaggtccccagtctccctcccctagtccctggtcccaccattctgctttctgtctcaatgaatttgcctaccgtaagtacctcatataaattgaatcataaagtatttgtctttttatatctggcttatttcacttagcataacattcttaagtttcatccatgttgtagcatgtgtcagaatctctctctttttttttttttttttttttttttttttttgcagacagagtctcgctctgtcatctagactggagttcagtggcacgatctcggttcactgcaacatctgcctcctgggtccaagcaattctcctgcctcagcctccttagcagctggaactacaggcgcgtgccaccatgccttgctaatttttgtatttttatgtggaggcagggtttcaccatcttggccaggctggtctcgaattcctggtcttcaccacgggggcccgaaggacccgggcaaagcgtggaggggagg

SEQ ID NO: 6 - DNA, 26928 bp, Homo sapiens
  unsure (12044),(12489),(26433),(26434),(26435),(26436),(26439),(26441): Identity of nucleotide sequences at the above locations are unknown.
gaagaccaagggcacacagcgaggcagtttcagggcgggcagcctggggccccacggggcggccccggacacttgttctcacctgtggagggcagagaagggaacagggagagaagtggccggctgggagtggaggtgggtttgaggttttactgtaaactaaatgtgtaccctctaccttagttatgaattatgagacacgaagactgcgaaacagacacactcctctaaaagtgcctctaggctgacagggagaaagtcccgccaggctcccagacgccacctttgagtccttcaacaagcccgccagggcctcttgcccaccggtgtcagctcagccactgaaccctccaggaagaagacgtgctggtaggagaagaatctcacccaggcacagcctggaaggggcacagaaggggctccggaaccagcaagcccaagttggaactcccagtctgctactttctagaacgactgtgcccttggcgggtctaagtagaacctctccgcgcactctttcctcctttgtaaagtggggacagcaatggccaccttgcaggttcagagagggcttgcagtacctcacagaactgagtgcccgtgaacgtgtgtgttcctccagatttgtgacagctttgccaggctggagtcaggctgaacgcctctgccctcatggggtttatattctaggaagaccaacaaaaacaagaagacggaaaattaaaacaacaaaagccccattgacaggccgtgaagaatgccatgaaaaatgaatggcgttgtgctgcagtctttggggaaacgggcttacggaaagaaggacacttgagctgctaccaatgagcagccgtccggtgggagggcagttcaggaagagcagacatccactgaggaggcgctggggcagagggcagcctggtcgctggattcgggggaggaaccacatcaggccatgagctggagctggtggtagaatgtacaggagaggccagccagggccagctcatgtcagacctcaagcggggaagatgaatcgagaatgcaccccacgagcaatgggaagccagtctacgatttaagcagcaaaaatattttcccttcttccaccctgcatccagctctaccagcacagcctggggttctattttcaagatagaatagacccagactcccagctcttcttacacttctactactgccacctgtcacccactcatgcgtccccacttgcagcctcgacccccttccacctgatctcatggcagccagggaagctccagggctcgtgagggctgccatctcaggaaagaagcaaaagccttcggcacctgcagggcctgctccaaccacacttcttccttgacctctcagcttccttagccactcccttcccacatctcaccctgctccagccacagtggtgtctctgtgggttctcaaacacaccaggtgcactcctgcctcagggcctttgtgcttgctgttctctgctgggactcttttttttttttttttttttgagacagggtctcactctgtggcccaggctggagtgtagtggtgtgatcgtagctcattgcaacctcaaactcctgggctcaagcaatcctcccacctcagcctctcaagtagttagcttttgttgttttgttttgagatgggatctcactctgttgcccaggctggagtgcagtggggcaatcttggctcaccacaacctctgcctcccaggctcaagcaattctcctgcctcagcctcccaagtagctgggattacaggcatgtgccaccacgcccagcttatttttgtatttttagtagagacagggtttcaccatgttggtctggctggtcttgaactcctggcctcagatgatccacctgcctcggcctcccaaagtgctgggatgacaggcatgagcctgtctctagtagttaggactacagagaggggccatcatgcctggtgatcctcccaccttttctgctccaactctttcaccccacttagcctcgtggctcactctcttacctcttcagctcctcagtcaggcctgaggacccctgttgaaaattgcaaaccacaccccccaccaccaccacccactattgccagcactttctactccatttctctgctttacttttctcctttgtactcatcaccacctgactcattacatgtttacgtatctttcttctctccactagcatggaagctccaggagagcagagagtgtagttttattccctgatgtgtttcctgtgcccgtaccagggcctagcacacagtaggtgctcagtaaatgtgtgttggatgaacaaatacagtgaaaggatctgatctacatttataaagaaggcactctggctgctgagtggggatgagactgtcaggaggaaagaggcccctgtgggggcctggccagcaggtgggtacaatggtagcagccaggagagagggcctcttggactcaagtggatggggcctgctcagggctccggccacaggaacaaagggaagggggcccaggatggcctgtcatagaggacacattacaactggcccaaagttcaagtcaggtttctaaatttgggaagggatacagaaaaactaaagactctactggacagtcagttattgaaatgattacatagaaaatgtaccaagaattaaaaaaaaaaaaaaaaagcattatgaaggggccaccagagactcccagagaggaaagggactatgggctggatgcggtgactcacacctataatcccagcactttgggaggccgaggagggtggatcacgaggtcaggagttcaaaaccagcctaggcaacatggtaaaacccccgtttctactaaaaatacaaaaaattagctgggcatggcagcatgtgcctgtaatcccagctactcgggaggctgaggcaggagagttgctagaacccaggaggcagaggttgcagtgagccgagattgagccactatgctccagcttgggcgacagagcaagactccgtctctaaaaaaaagaaaaaaaaggccagatgaggtggctcatgcctgtaatcccagcactttgggaggccgaggtgggtggatcacgaggtcaggagatcgagaccatcctggctaacatggtgaaactccatctctacttaaaatacaaaaaattagccgggcgtggtggcgggcacctgtagtcccagctacttgggaggctgaggcaggagaatggcgtgaacctgggaggcggagcttgcagtgagccgagattgcgccactgcactccatccagcctgggcgacagagttagactccgtctcaaaaaaaaaaaaaaaaaaaaaattagctgattagttgggcttggtggcgggcgcctgtaatcccaactactcgggaggctgaggcgggagaatcacttgaacccgggaggcagaggttgcaatgagccgatatcacgccactacactccagcctgggcgacagagcaagactccatctcaaaaaagaaaaaaaaaaagaaaggggctgtgctgtggcctgggacccaaagcacactactgcaaggtcccagggtgcctgactccaaccggagccttgagaacattcatttgcaaagaatgaattaaaattcagcactattttattctgcaggattccagcaccccaaggacagtcatttttagacccttcagtaacgtaataagtaaccggaggatgtgctgagcttccacttccccagacggttgcctgtcacagctcatcaggccaacaaacttttcttaggcctcaaatttggaaatgttcactctcagttcgttccttagatgcaagtccatcccaatgaagtaacaggggctcagcacctgtccaatctcattgcttccggggacaggggcccatgaggatgtcgtttcagcccggtgacacttgggcaaagtgccttttggtttccctcccaggctggaacgtgctggctctgtgaagttacgctgggcacaagagccccccccaacccggcaggactgactgctgtggtcagaggcgcccctggggctttgggagccacagaatcttcctgagggcagcgccggaggaggccccagtgagagtgcccactgccaggctcattcctcaggctgccgcaggcctctccccaaaacaggcaatgcttctcagcaacctgccccaggagcaggccagggaaggccgccatcggcctacagtgctgggctctggagggcttggttggtaacaggccatggtttctatgagccagctggggtgtgaaggacacaggctggattcacctctctgggcctcagtttctgcattcaaaaagtgggaatcatgatatctgctctatttcttatctctcagtgctgatgtgaacctccaataagacttttaaaaatactctttctaccttacttttatttttcatttattttaagataatgtctagctgtctcacccaggctggagtgcagtggtgtgattacggctcactacagccttaacctcccaggctcaagtgatcctcctaccacagcctcccaagtagctggaactacaggcatgcaccaccgcacctggataattttttcttttgagacaaggtttcactctgttgcccaggctggagtgcagtggtgcactcttggctcactgcagcctcaacctccctgggcttaggtgatcctcacacttcagtctcccaagtagctgggactacaggtatgtgccagtacacccagctaatatttttgaaggatggggtttcactatattgcccaggctggtcttgaactccagggtttaagcaatctaccttcctcagcctgccaaagtgctaggattataggtatgagccaccccccggcctataatcctaccactttaaaaaagcctgtaattttagcactttaaaaaatttttctaaattttttatagagatgggggacagctgtggtctcactgtgttgcccaggctggtcttgaactcctaggatcaagccatcctcctggcctggcctcccaaagtgttgggattataagcataagccttaccttaccttttttttttgagttgcagttttgttcttgttgctcaggctggagtgcaatggcaagatcttggctcactgcaacctccacctcccgggttcaagcaattctcctgcctcagcctcccgagtagctgggattacaggcatgcgccaccacacccagctaattttgtatttttagtagagatggggtttctctatataccttaattttaaagcactgcattcatgtaaattgtgattaacatggattcaagagagggagtgaggatgaatgagccaggcagtcacctcggctgtcaccctccacttctctcctccttctgacagtcatcgtccatccgtttctgcagctgtttgtttgactctcctgatcattttgcttgccacataacttgcctcctgggaaagaatgccctgggcaggcccacatgagtagtgaaaaataatctgcagtgaaaaataaaactaagtagtctggtccacagagcagtcttattttttcactgcagatgaaggagttgacattcaggcttcattctcatttataagtgttttaaagacacatacagtggattgaacagtggccttcaaaaagatgtatctacatcctaatccctgggacctgtgaatgttaaccaagttaggaaaagggtcttcccgggtgtcattaagttagagatcttgagatgaggagctcatcgtggattatccaggtggaccctgcatccaaggacaaatggtccttagaaaagaaaagcagaggctgggcacagtggctcaagcctgtaatcccagcactttgagaggccgaggtgggtggatcacctaaggtcatgagttcgagagcagcctggccaacatgatgaaatcccatctctactaaaaatacaaaaattagcaaggcatggtggcgggtgcctataatcccagctactcaggaagctgaggcaggagaatggcttgcacctgggaggcggaggttgcagtgagccaagatcgcgccactgcactccagcctgagggagaaaagtgaaactctgtctcataaaagaaaagaaaagcagacagagatctgagacagaagaggagagtgaaggaaaaaaggccatgtgaagatgaggcagaggttggagccatgcagccacaagccaaggaatacctggagccccagaagttgcaagaggtaggaagaagcctcccctagagcctccagacggagcacagccctgccaacacctccacctcagacttctggcctccagcactgtgagataatcaactgctgttgttttaagccaccagatttgtggtaatttgttatggcagccacaggaaactaatacagtacctaatcttcacaaacccatcttacagaaaaggaaactgaagtcagagaggtagtggcttgtgcagtgtgttaggccattcttgtattactataaagaaatacctgaggccgggcatggtggctcacgcctgtaatcccagcactttgggaggccaaggtgagtggatcacttgaggtcaggagttcaagaccagcctggacaacatggtgaaaccccatttctactgaaaatatgaaaattagccaggcatggtggcgtgcatctgtagtcccagctactcaggaggctgaggcaggagaatcacttgcgcccgggaggaggaggttgtagtgagccaagattgtgccactgcactccagcctgggagacaagagagaaaccctgtctcaaaataaataaaaaacaaataaacacctgagactgggtagtttataaagaaaggggttaactggctcccggttctgcaggctgtacaagcatggtgccggcatctgcttggttgctgggaaggcttcagggagttttactcatcgtggaaggcagagccagagcaggtgcatcacacagcaaaagcaggagcgagagagagagagagcagggaggtgtgcacacttttaaatgagcagatctcacgagaactcaccattgcaaggacagcaccaagccacgaggggtctgcccccatgacccaaacctcccactaggccccacccccaacattgggaattacagttcaacatgaggtttggggggacaaatatccaaactatatcattccacccctggccccccagatctcatgttcttctcacattgcaaaatatagtcatgccttcccagtagccccccaaagtcttaactcatcccagcattaactcaaaaatcccattcccaagtccaacgtctcatctgaagatgagttcctttcacctacaagactgtaaaaatgaaaacagttatttactgctgagatacaatgggggcataggcattaggtaaacattcctgttccaaaagggagaaatcggtcaaaagaaaggggctataggccccaagcaagtccaaaacccagcagagcaatcattcaatcttaaagctccaaaataacctccttaaactccatgtcccatagccagggcacactggtgcaaggggcaggctcccaaggccttgggcagctctattcctgcggctttgcagaattcagtccccatggctgctcttacagattggagatgagggcctgcggcttttccaggtgcagggtgcaagctgctggtgatctaccattctggggtgtggatggtggcggccccgtcccgcagctccactaggcattgtcccagtggggactctatgtggggcctccaaccccacatttcccctccaatgggaaggctctgcccctgcagcagccttcttcctgggctcccaggctttctcatacatcctctgacatctaggtggatggtgtcaagcttccttcactcttgcactctgcacacctacaggcttaacaccacatggaagctgccaaggtgtatggctggaaccctctgaagcagcagcctgagctgtgactatggccctttgagccaaggctggagctggaacagtctagatgcaggcagggagcagtgtcctgaggctgtgcagagcagcagggccctgtgcctggacaatgaaaccattctttcctcctcatcctctgggcctgtgatgggagggttgtggaagatctctgaaatgcctttgaggcctttttgcctctgaggcctatttcctattgtctcagttattggcagtcggctcctttttagttatgcaaatcctctagcaagaggttactccactgccggcttgaactcctctcctgaaaaagctttttctttctttgtcacatggccaggctgcaaattttccaaacttttatgctctgttttacctttaaatataacttctaactttaattcatttatttgctcctgcatttgagcatagggaattcaaagaagctgggccacatcttgaatgctttgctgcttcaaaatttatggccacgcttggtggctcacacctgtaatcccagcactttgggaggcctaggtgggcagatcacgagatcaggagatcgagaccatcctggtcaacatggtgaaacccatctctactaaaaatacaaaaaaattagcttggtgtggtggcgcagacctgtagtcccagctactggagaggctgaggcaggagaattacttgaacctgggaggcagaggttgcagtgagcccagatcatgccactgcactccagcctggtgacagaataagatttgatctcgaaaggaaggaaggaaggaggaagggaagaaatgtcttccccccagatgtcctgggtcatccctcttatgttcaaacttcaacagatccctagggcatgaaaataatacagccaaattatttgctaaggcataacgaaagtgacctttgctccagttcccaataagttcctcatttccatctgagactcatcaccctggccttggcttgtccatatcactgtcagcattttggtcacaatcatttaaccagctaatcgggaggctgaggcaagaggatcacttgaacccaggaggttgaggctgcagtgagctgtgatcacatcactgcagtccagcttgggcaacagagcaagatcctgtctcaataaataaataaataaatacataaataacttaagtttatttaaagctgcatctttgccaccatggagaaaggccaggccagctccttctctctttctgcacgtgttcctcccacctcagctgcctctgctcctcaaggaggaacagagggagtaggaaaggccatcccaggaggcccagcaccccatgacctggctctggggccttgtgggtttatggattcccagtgctgagtcatccctcacaggctcttgtgggcaccttggacattggtcagaagcatgtggtccccgggaacacaccttttcctgatcatctgggaagggcagcttgtgccagcgaggccacctgttcagcgccacggcccgccagacagctgcagccacagccttgcctttgatcagagcaaacaccagacatgtgtgtcatgcccccaacccatctccaggggacacatgtcctttcttgccaggcctgagatgaacaagagagggacaagtccccaagcctctctctccttcctgcctcacccactccgctgttagattctcaaggtggatggtgggctaactagggcaaccgaccatcctggtttacctagaactgagggggcattttcaggaataaaactgcaaaagtctggagcaaacaggagcaagttggtcactctggggctggtggagtcaggtttccttctgcaggccccctccccgcaagcatgggtggaacccaggacaggaacacagagcaggccccaggaccgggcttgtcacttacaagtcttttttttttttttttttttgagatggagtcttgctctgtcatcagggctggagtacagtggtgccatcttagctcactgcaacctctgccttctgggttcaagtgatccccctgcctcagcctcctgagtagctgggactacaggtggcaccaccacgcccagctaattttttgtatttctagtagagatgagatggccaggctggtcttgaactcctgacctcaagtgatctgcccgccttggcctcccaaagtgctgggattacaggtgtgagccactgtgcctggccccactcacaagtcttaaaccatgcctcagcacatcaatgccatttacaaaaaggtagagggattttccaggcaaaaatagatgaaagacataggatgattgatcatgtcctgcttaaacataggtctgatgctattaagaattgagggctgggagcggtggctcacgcctgtaatcccagcactttgggaggccgaggcgggcggatcacgaggtcaggagatcgagaccatcctggctaacacggtgaaaccccatctctactaaaaatacaaaaaatggccgcgcgcggtgactcacgcctgtaatcccagcactttgggaggccaaggcgggcggatcacgaggtcaggagatcgagaccatcctggctaacacagtgaagccccgtctctactaaaaaatacaaaaaaaattagccaggcatggtggcgggcgcctgtagtcccagcaacttgggaggctgaggcaggagaagaatggtgtgaacctgggaggtggagcttccagtgagccgagatcacaccactgcactccagcctgggcgacagagtgaaactccatctcaaaaaaaaaataaataaataaataagaattgttagtattttgcaggtgtgacaaatgattctgtttctgtggcagaatgttctcaggagatctcttttgaactctcatggaaagcatcatgctgttggcaacatcacatttatttttatttatttattattttttagagacagggtcttgctctgttgcccaggctggagtgcagtggcacaatcacagctcactgcagcctcaacctcctgggctcaagcaatcctcctgcctcagcctcccaaagtagctgggaccacaggcgtgagccactgcactcagcccaatgtaccttcaatatttacatttctggcaaaggtagcaaaaccttaacaaattttgaatctagataataaaattatgaggctgggtgcagtggccctgacagggatggctcacatctgtaatctcaacattttgggaggccaaggtaggcggatcacctgaggccaggagtttgagaccagcctggccaacatggtgtaaccctgtctctaacaaaaatacaaaaaaattagccagacgtggtggtgcacgtctgtcatcccagctactagggaggctgaggcaggagaattgcttgaacccgagaggcagaggttgtgatgagccgagatcgcgtcattgcactccagcctgggcaaaagcaagagcgaaactctctctccaaaaaataaaaaaaaaataaattaatgaattaattaaaataaaataaaataatggatagtcactgtaaagaaaaaataaatgtatatatcagccaacaagtgatggaatagagcaccccatctccctggctggacagatacatcccacaacacctggaaggcggctccatgtagaactttctggactgcttgaggtgctgtgctggagcacggtgacagaggagctggaccatggacctcccccggcccccaccaagggcgaggtccccctgtggtgggtctgagggaggcatccgtatggcctctgcggcttgggcagggaatttggggtccaagtacttggtgcaaagcctggaaagagggtttgggtgctgagggcatatcccctgggccacatgggggcagaagtggggccccctgaagcttggagtcctgggcaggggcatctattttgctgtctgaggccttcagtacttgaagcaaaatggaggcagaatgtcccaccttaatgcccctgattcctccaaaccaattccagagacagcaagggccagaacagggatggccctgcccagggtcatgcancgaggaagtggccaggctgggatctgaacccaggctaatcccctcccttgtcctcctccaggccctcacccctgcatagagccctccagctcactcatcctcggccagctccatctcctcagcttgtaaacccccccgggattttcctttcttaaaaaacaaaggcttggccaggcacggtggctcacgcctgtactttgggggtggctcccagcactttgggaggccaaggtgggcggatcatgaggtcaagagattgagaccattctggccagcatggtgaaaccctgtatttactaaaaaaaaaaaaattaactgggcatggtggctagctacttaggaggctgaggcaggagaatcgcttgaacctgggagaaagaggttgcagtgagccaagatcgcgccactccactttaacctggcaacagaacaagattccgtttcnaaaaacaaacaaacaaacaaataaacaaaaaaaggcggagcgcgatggctcgcgcctgcaatcccagcactttgggaggctgaggcgggcggatcacttgaggttaggagtttgagaccagcttggccaacatggtgaaaccccatttccactaaaagtacaaaaatcagccaggtgtggtggtgggtgcctgtaatcccagctactcaggaggctgaggcaggagaatcgcttgaacccatgacctggaggctacagtgagctgagattgcgccactgtactccagcttgggcaacaagatttgtttctctaaaaaaaaaaaaaaaaagactggcccttccccttcagctcttcctcagggtccctgagcactctacacccccgtctacactgagcactccaccctgctgtctacactgagcactccaccctgccatctacactgaggactccaccccactgtctacactggctgcctcccgccctcacctcctgctaaggccattccccgctgcatctgtcttctagattctgcagccttcagcacgctgggcccctcctttgtccccttgagccacctccagcctccccctgagctgctactcctctcccagcagcctccacccaagcccctccagtccccaagctgtcccttgcatccagcactgcccttccacgtgccccttccctccagcttcacagcagggtggggcctccaggccctgcccactgtgcccatccacaagttgtggtgggagctccgaggggaggcaggggtgtgcatggacttgggacgtccaagtctgggaccaggggcagctggttggtggagtgtggagggggatagggactttcaggtagagaggctgtaggggcaagatcgggacggcggatgtccctaaggagggctctgacctgggaaatattgtgcagcttcctctttgccattcctggagctcagacactggccggctctcaccccgcccttcctgcaggacacagctccatcccagtgagttcctagtgtagacatctccagcagcacggatgggaaaggaagtcatcaaaggtgcccaggaccggaggctttttctggaggtggcagaggagggtgtgggtctcagggctctggctgagggcaagcgtgggaggtcttaggtctgcaccagccccgtgaaggcccctcctgctccctggtggagtcctagagggaacagcagcccctaggctctagcaggagtgggtaggggcttttctggcttcctactgtgccagcaggatagctgggcctggcactgagcccaaagatcacatgccggggcattggcgcagtgaggaacagacccttgccaaagctggcaaagaagaccccatggggtgcagctggtgaagctgagagctcaatgtttgggggagcctggcaaaaggggtcctcccctccctctgcaggccaggatcgcaggttttccctacatgttggtaattctcaaacaatcccatggccactggagcaaagatcacagtgggcggcggcctcgggagcagtggacagggcacgcagtgcctttgatgccagagccctcgccccaaagtcaacaaactctgcagcggactttgcacccggactttgttttcaccatacaaggaaagggacagatcacaggccctctcgctgccctcgctgagccggaagctgcagcgtgagctctctcaagccccatttctaggttccccaggcgcacccctgagcccctactcgcctattaagttctcctaatagcccttcaaggtcttaatgtatgtccattagacagaggggaaaactgaggcgagggcaagtgacttgaccgaggttcctcggcgagcagggcgtggagctgagaacctcgttattactgctccccacacaaccctctggccgttcttggaagaaggctgagccccgggggggccagagtgacccaaacaccatgggccgcctgcggtaacacgtgcggccacgaaggggcagcagtttcccgcccggccgggctctctccggcgctcagtatccgtcccaggccaagaagaagaaactcggggaggagggcggagggggctgcgtgggagggcgtggaagatggacgtggccaggggagtggcagctgcacacagtggatgctgttaagatgaagggaaagaacgtgggctccgagatcactggacacggttccacctttcttcccgctcactgcatggccctgggcgggttgttgaacccttggaaacctgtttttccttttttcctttttttttgagacagggtcttgctctgtggcccagactggagtgccgtggcacgatcttggctcactgctgcctcccaggttcaagtgatcctcccagctcagcctcctgcgtagctgggaccccaggtatgtgtcaccacagccggctaatttttgtatttttttgtagagacgggatttcgccgtattgcccaggctggtctcaaactcctgagttcaccggatcttcctgcctcagcctcccaaagtgctgggattactggcatgagccaccgcacccagcagagacctcagttttctaacctgtgccagcaggaataatgatagctgcctagcttggctgtgctgggaattaagtaagatgaccgggtagcaaatatgaagtattactggacacagagggccccaggctgggttagcagcggtggtcagggctgctgcttcctggcctgagctcgaaggagggccctcattaccacctgggtgagtcctcgtccaagcctggcactgctgcgtgggaataacttctgccacccaagttggcagattgtgtgcaaagttaagtcctgactctgtggggtggacttcgaggcctcttcatcggacctgcttccggtgactgcattcgcacctcctcctgttcctggtttaacacagcccagctttcctcctgctgagccctccctgggcctgctgtcaccctcgtgccgctgtgcctcgcagtgccactccctgtaccctgaatactttgccctgcctctccacccagctgagagtcagggcccctgtgaggctctgcccagcccgtcctccgggtttctgcctctgctgagcacttccctgcatgattgcttctgagagtccccccagcctgtgagcttctcaggactgggacagcttctcaggaccgaggcttcctggtctgcttgcaattttacaggcgggcacattttcccttggccaacatcagagactggacatctgcagatctgtgctagccactgagcacccaggcaccccagcaggtagctctgtaaccaacccattctgtaaagctgaggctcagagaggtgaagcgcctggcctggggccacagcctgcgtcagctgcagagccaggagctgagatatgcacctgcggctctgctcacagggtcctgcacagactgctgctggagccacctatgtagagtcaagagagttcatgttaactccctctcacatccctcagccagggtgggggctgacgatagacactcagggatggcctaccctccccaacaacccccgtcaggtttgccggatctccttggaagaaaagttctgggcagaattccaccgttggcctggcctacactctccttagtggcttaggaccctcagcggtggataagttgtgggcagaagagatgcaatcaggattctcacccactcaccccttgccagccccaataagctcaataagctgggctcggtctgaggaagtgtccaggaaatgtgcaaatggcctgggacagccctgtgttcctttcagtaaggttgctgaaggtgaggctgaaagttggagaaacagaagccagtgcttatggttttaattaagataatggaatgtatgtatgtatgtatgtatgtatgtatgtatttatgtatttatctttagagatagagtctcactctgttgcccaggctggaatgcggtgacacaatcatagctccttgcagcctcgacttcctatgcccaaatgatcctcctacctcagcctcctgagtagctgggactacagacacacgccaactatgcctagctaatttttatttctattttttgtggagactgggttctcactttgttgcccaggctggtcttgaacccctagcttcaagcaatcctcctgcctcagcctcccaaagtggagggattacaggtgtgagccaccacacctggcctggaatttatttgtattctgcttataaaattaatacattcttattgcagaaaagtttgaaaataaaagaaaggacaaagaacaaaaagcgtatataatttcacagctcagatctcactgctattaacatttttatttactttcaggcttttttctttctaggtacatatgcagagattattttattttatttattttattttatattttattttatattttttatttcattattttattttattttattttattatttttagagacagggcctcactctgtcacccaggctggagtacaatggagtgatcatagctcactgcagcctcaaacacctgggctcaagcaatccccccactcagccttctgagtagttgggactaaagtgtgagtctggctaattttttttactttttgtattgacagaggtctcactatgttgcccaggctgatctcaaactcctgggttcaagcgatcctcccaccttggactcccaaagtgctgggattacaggcatgagccaccatgcctggcctaaaatgccactttttgtcatttactaaaatcccatggacactttgacatgtctgtattctatgctattgatctgactgttggcatctacatcattatggccatctatcatctatcataatccattttaacattaaaattgtgctgctgcttagatttttctggcctgtctcctatttgtattcttccagataaattttagaatcattttatcaaattccccttgcagaaaaagccctattggattttggttgaaaaatactgaatttttacattaacttaggaaagggctgggcacggtggctcacgcctgtaatccctacacttttcgaggccaaggcaggtggatcacttgaggttgggagtttgagaccagcctggccaacatggtgaaactcggtctttactaaaaatacaaaaattgccaggcgcattggctcacctgtaatcccagcactttgggaggccgaggtgggtggatcacgaggtcaggagatagagaccatcctggctaacacggtgcaaccccgtctctcctaaaaatacaaaaaattagccaggcgtggtggtgggcgcctgtggtctcagctacttaggaggctgaggcaggagaatggtgtgaacccaggaggcggagcttgcagtgagccaagatcgcgccactgcactccagcctgggcgacagagtgagactccatctcaaaaaaaaataataataataatacaaaaattagccgggggtcgtggcgtgcacctataatcccagttacttgggaggctgaggcaggagaatcgcttgaatccaggaggtggaggttgcaatgagcagagatcgtgccactgtactccagcctgggtgacagagtgacactctgtgaaaaaaaaaaaaaaattctgaaggattgagactcttagactcttaggtcttcctatccaagagcacaatatagcttttcatgtattcaagcctttttcaatgcatcaacagaattttacagtttttttcatgatatcctgctatttcttataaaatgtattcctagatattctgcatgttttccggttgtttgttaataaatatttttcatttgtcattatttcctaattggctgttatttgtatatatgacatctgttgaattttttgattactttgaaaatggccattcttttgtgtttttttttaactttctattttgagataattttgacttacagaagatttgcaaaaatagtacagagagttcctgtttcccccttatgttaacccagtttctccttatgttaacatcttacataactacagaacaattgtcaaatctaagaatcaacctgggcacaatgctattaactaaactgcagaagctgttcagatctcaccagttcttctactgctccccttttctcttccagtgttcaatccggaatcctacattatatttagttgtcatttctctttggtgtcttccaatctgtgacagttcctcagtctttctttgtctttcatgactttcatttttttatacttttgaaaaatactggccggttgttttgtagaacgccctcagtttgggtttgcctgaagttttttgtgattagatcgaggtcatgcattattggagagggtgccaccgcctcgatgtgcaagctcaatgcatcatatcagagggtttgtaatgtcagtttataccgccggagaccctaacctggagcatttcgtgaaggtgctgtctgccaggattctccactagaaagttactatttttccctttttaattactgaatgtctgaggggaaatactttgagactatgcaaatatcctgtttctgctttaacttcggctcactaagtttagcattcatctatggatctcgcttatagcaagtattactgtggagttctaatggtaattttctgtttctctcattccttcaacctttattaatatgcttcttcctcacttattcattttgtttcagttgtttataccaacatggatttgtggatattggttttattctttgggttgcaattgaatcctatcattattttgttagtcagttgttccatccgaccttggtcattaggagcccttgaaatttggctcccatgcctttttttttttttttgagaccgagtctcactctgtcacccaggtttgagtgcagtggcatgatcttggcttcctgcaacctccgcctcccaggttcaagcaattctcctgcctcagcctcctgagtagctggtattataggcgctccaccaccttgcccggctaattttttgtatttttagtagagatggggttttattatgttggccaggctggtctcaaactcctgacctcaggtgatctgcccgcctcggcctcccaaagtgctgggactacaggcgtgagccaccacacctggcctcctatgccattttaacatgcccgtcttttctttttctttcctactttctgtgactgtaagaagctccaggatacatttttgctgccctagacttagcctcaatcagttctcagaaaagctctggttctttttatgggatacttagaaaactagctctgtatggcctggcgcggtggctcacgcctgtaatcccagtactttgggaggccgaggtgggcagatcacagatcacgaagtcaggagatcaagaccatcctggctaacatggtgaaactctgtctctactaaacatacaaaaaattagtccaggcgcggtggcgggcgcctgtagtcccagctactcaggaggctgaggcaggagaacggcatgaacccgggaggcggagcttgcagtgagccgagatcggcagccactgcactccagcctgggccacagagcgagactccgtctcaaaaaaaaaaaaaggaaaaagaaaaaagaaaactagctctgtatgctagttttttttttaagacagggtctctcttgccccagctggagtgtagcagcacgatcacagctcactgtagcctcaaccttctgggctcaagcaatcctcctgcctcagtctcctaagtagctgggtctacaggcatgcaccaccgtacgtggcaatttttaaaaactgtttgtagagatggagtctccctatgttgcctggtctggaactcctggcctcaagtgatcctcctgcctcggcctcccaaagtgctgagattacaggcatgagccactgtacctggcctggccaaggtctgtctttttttaaaagaagttgttgtatagttgtttttttttttatttttttttctgagacggagtctcgctctgtcgcccaggctggagtgcagtggtgcgatctcggctcactgcaagctccgcctcccaggttcacgccattctcctgcctcagcctcccgagtagctgggcctacaggcgcccgctaccacgcccggctaattttttgcatttttagtagagacggggtttcaccgtgttagccaggatggtctcgatctcctgacctcgtgatccgcccgcctcggcctcccaaagtgctgggattacaggcgtgagccaccgcgcccggcctgttgtatagtttttatctcgagttttctagcgatttaatcatattggttacaaaaaaggatgattttactacctcctttccaatgtttctacatattttttcattttatctaactgcattttaaaataaacttttaattttagaatggtttcatatttacagaaaatgtgcaaagatagtacagagagttcctgtgtactccacacccggtttccttattattatcttaacgtgatacacaattaataaaccagtaacattattattcactgaagtccacactttctttttttttttttctgagacggagtctacttctgtcacccaggctggagtgcagtggcgcaatctcggctcactgcaacctccacctcctgggttcaggcaattctgtggctcagcatcccaagtagctgggaatacaggtgcccgccaccacgcccggctaattttttgtatttttagtagagatggggtttcaccatgttagccaggatggtcttgaactcctgacctcgtgatctgcctgcctcagcctcccaaagtgctgggattacaggcgtgagccaccgcgcccggcgtccatactttctttagatatccttcctttttacctaacgtccttcttctggttcaggatcccatccagaaagcaacattacccctcgccatcacgtcttcacaggctccccttgacgggaagagttcctcagactttccttgtttttgttgaccttgacagttttgaggaggactggtatcttagtctgttttgtgctgctatcacagactagctgagaccgatacatgatacatgaaaaaaaatgtattcttacagttgtggaggctgggaagttcaagacgaagttgctggttggtttggtctctggtttcaagatggcgccttgctgctgcatcctctggagaagaagaatgcggtgtcctctcactgcagaagatggaagcgctaaaaggaatgaactccctttgccaagccattttataatgggcattaatccacaaaggatgaaaccctgagaaacatcaagctttaaagcactggttctcaacctttttggtctcaggagccctttatactcttaaaacgttttgaggatcccaaaaaaaggcttctacaggttccatcttttaatatttaccatatcaaaaattaaactgaaaaaattttaaattatttattcatttaaaataacaaggataaacccattacatgctaacataaatcatgtattttatgaaaaatagctatatttatcaaaacaaaaattagtgagaagagtggcatgtataattttttttgtttattttttgtttttagatggaatcttattctgtcgcccaggctggagtgcagtggtgtgatctcggctcactgcaagctctgcctcccaggttcacaccattctcctgcctcagcctcctgagtagctgggactgcaggtgcctgccaccacgcccggctaattttttgtatttttagtagagatggagtttcaccgtgttagccaggatggtcttgatctcctgaccttgtgatccacccgcctcagcctcccaaagtgctgggattacaggcttgagccactgcgtctggcctaaatttttgtgaatgtctttaatgcctgccttctcatatttgtttctgcattcaagttattgcaaaatgttgtgttggttgaagtttgtaaagaaaatgtggcctcatacagttgtgtagttggaaaggcaagagtattttgattctctcttcaaacaactatggacaacctgctgttacaaaaccagaatgcaaaaagttgtagtaaatacaggttaggtgtagtgtggaatctgaaagcatgtgaatgaactttctgagttttgtaacattaaagtccagttgcgttaagctactgtgatagcatatagcattgtcctaatactggaattagtatcagaagtggggtgctactgttaataaataaaaagaaataaataaatcatgtgatactggctcagaagtcaggcagtaggctgtgtggaacctgacatcacgccatgtaatacattggcaaccatttgatccagctgtctgtcatgatgacttggaaagtcaaccacatacttacagagcctgtagacataggggaaaatagtataaaacagaatactaacagtggaccttggttcttgccagttgcatttagccaaatattaaacaaaagagatattcttgggcagcaactggaccatcttcaagtaaaagtgaaaggtaataaacagagtccagacatttgtgcccatgcgggttaagaaaaatccagttgcttctagacaccgtatatgaaaacaacgctgaaaacaagcctttgagtggtaaaggccgattaacactcagcgcggtaacaaagaccaggtgggctaacccgaaatgaaatgagaagcctgtggtgatgaggaggcagagaagtaaaatcaagtttgagcatttcgtttaggagagtttgggctctgattacttgcacatgcaaacgaactggaaacaaacagatcagatgtctaccacttcttcgagggaattgcattgccaaagaagtcatgaaagcagactctatactgattaggcattaaaacaaaaacaatctttaggcccctaaacttgcatgggcaggaagtgggctgtcaaagctgttcatcctctaaggtggacctagttcctagtccccagtatacacttcagatgtggccctggaggacactggacatggaggacctcccagaggatgaggctagggcttcatttctccaatgacctcagctgcctctatttccccttcttcctctggaagtcctatcatcgttattattattattatcatcatttttattttgagataaggtctcgctctgttgcccaggctggagtgcagtgacatgatcatggctcactgcagccctcccaggctcaagtgatcctcctgcctcagcctcctgagtagctgggagtacaggcacatgccaccatgcttggctattttttttttcagtagagatagggctctcactatgttgccagggctgatctcaacctcctgggttcaagagatcctcctacctcagctcctgagtagctgggattcgggtgcacaccaccatgccaactaatttttaatttttttttgtatggacaggatgtacagtgttagaaatggattgcttgcagaggcaggaggatcacttgagcccaggagtttgatcacactgtgaaccatgatcgcacccctgcactccaatctgggcaacagagtgagaccttgtctcaaaaaaaaaaaaaaagagagagagagagagactcaaagataggcaaaaaagtgggaaagctttatagtggacaaaaaggaacgctctaagtctgccctattggcatggtgctgaaggtgggctaactagagatagggggtactatgtggttgactatgggtgcatctttggctttccctgggtgatcctaagttggaagcagggacaaaaattagggaagctgttagttattcatcacgttctggcagtagtggactggttgtgatagaagttattgttttggccaggtgcggtggctcatgcctgtaatcctagccctttcagagttcaacgtgggtggatcaggaaggagggaggatttgggaggtcaggagttagcctggctaacctggcgaaatcccatctctactaaaaatacaaaaattagctgggcgtggtggtgcatgcctataatcccagctactcgggacgctgaggcaggagaatcagttgaacctggggaggcggaggttgcagtgagccaagatcgtgcccaatttcatctcaaaaaaaaaaaaaaagttatcgtttagcttcctcgattgttactggacgtagtaatctggcttcctgcaagtctaactttcagcagactggctacatgggctgtgtactgtagataaggcagtaagtaaagcaaaaattgatagagcatcaaggataaatagaaaatccgtaatcaagcagaagatttgaacacttcactttcagtaactgataaaacaagtagacaaaaaaaatcagtaaggatgtagaagatttgaacaacgtaattaacaaacttgacttgatttacacgtctagaaccctgcagaacacacactttttcaagcatactcagaacatttatataaagtgaccatatggtggaccataaagcagtttcaacaaatctcacaggagtaaaataacagaccgtgttttctgaccgtaagtacagttaacctagaaattgaaaacaaaaagctagaaaaaccccatgtatctggaaattttaatatacactttgaaataacaaatggatcagagattaattcaaataggaatttagaaataccttgaactgaaaaataatgagaatactataccccaaaactgtggggtgcagctgaacagtatatagacgaaaagtatactcatatgtgcataccttaaggagcggggaggattgaaagttaatgggaggcaaaagcaggtggatcacttgaggttaggagttcaagatcagcctggctaacagggtgaaaccccatctctactaaaaatacaaaaaattatccaggcgtagtgaggctgaggcaagagaatcgttggaacccaggaggcagaggttgcagtgagccgcgattgcgccactgcaccccagcctgggagacagagcgagactccatctcaagaaagaaaaaaaaaaaagaaaaggccaggcgcggtggctcatgcctgtaatcccagcattttgggaggccgaggtgggcggatcacgaggtcaggagatcgagactatcctggctagcacggtgaaaccccgcctctactaaaaatacaaaaaaattagccaggcgtggtggcgggtgcctgtagtcccagctactcaggaggctgaggcaggagaatgtcatgaacccaggaggcagagcttgcagtgagccgagatcgcgccactgtactccagcctgggcaacagagagagactctgtctcaaaaaaaaaaaaaagttaatgggataaacatccatctcaagaagttagaaaggaatgacaaataaaccaaaaaaaaaaaaatcaaaagaagaaaatcataaggtcaagactataaagagagtggctgggtgcagtggctcaggcctgtaatctcagcattttgggaagcagaggtgggcagatcacttgagcccaggagttcaagaccagcctgagtaacatagagagacctcatctttgctgaaaataaaaataaaaaattagccaggcatggtggtactgaggtgggaggatcacttgagcctaggaggttgaggctgcagtaagccatgattgtgccactgcacttcagcctgggtgacagagtgggaccctgtctctaaaaaactaaaataaggctgggcgcggtggctcaaatctgtaatcccaccactttgggaggccaaggctgaggtcagcagtttgagaacagcttggccaacaagatgaaacctcatctctactaaaaatacaaaaaattagttgggtgtggtggcatgtgcctgtaatcccagctacttaggaggnnnnctntngattatattttctccttcctacgtcgttattggactgaattcagaatgatgactctcattggagctcttcctgtctcctaactacagtggcttccgaccccactctggttttcacttcacccctctgctgctcatacgagtagatacttccttccttctttctcacttgttgctcttcctcaaccccccccgttggtgtcccctcctctttatctttttctcgcgacacctgcgttctcttgccctcttatcatccctttctcgaggcggtcctttcctttatccagcttaaataccttctcctctgtttatttgggggttgggtttttatctctcaccctccctctaatttctttcctctttccgcacccatcaagcctctcgtggtttctcttcctctactctcgggtcccccccctctccccttctttttttcttcacccccccaagcgctttgccttttttttctttgccctttattcccccc

SEQ ID NO: 7 - DNA, 29430 bp, Homo sapiens
  unsure (4336),(4345),(4349),(4392),(4447),(4490): Identity of nucleotide sequences at the above locations are unknown.
aggggaagggccggctccgtagctcacacctataatcccagcactttccgaggagagaggatcatctcaggccaggagttcaagaccagcctgggcaacacagcaagaccgcatctctacaaaaacttcttttaaagcttaaaaaaaaaaaaaaaagcaaagaggacagttcaggagaaaagcctgtagaggcagcacactaaggaggagacgcagcccaggcaccaggaggggctggccatgggcactcactcctccagcaggcgagtgcccagcaccagctggcccacccagacacccaggacacggcctgaatggctccgtattcacgtgggtggtaataaacaagcaatacacatagccaataaggacaccttagtaatgttacatcataaacgctgcagatcagggaaatggtgcagggtgaagtgggttggggggctgcatgctacatgagaagtgggtcggggggctgcatgctacctgagacagagcaggccttgctgggaaagaaggagccggcaggcctgggcaaaggtcctggggtgggagcacactggagcagagtgtgggggtagcatggcgggtgctggtcctctgggcgccttcccaccacgtcatgtgcccatgtgcccaaggtctctcgtttcacagccccctgaagctcaggggtcacagctacacagcccccagataccttggcctgccccaggtcattccatccagtgatggacctgctgacctctagcctgacctctgggcagcgtaatttgagaaggaggagaagggagggcaacagacctggggcgatgagggatgcacagggtggcagacacctgaggctgcaccttggagcctcagttctgggtgtgggtgggggatggacaggctgagggctgaagcagctgggcccggccaccatcacaccccaggacccaccagatcaccatgaaaaaccgaatgtcaactggcagcccagagtgcagaacaaacctttcagaaacacggtggtgactgccgcatcatgaacataaaataattacgccctctccccagggatcacccctgcaggagtttgtcccaagaaacaccagaaagaaggaaaacgtctgagtcacaatatttgctgaggccttatttgtaatagcaaaaaaaaaaaaaaaaaaagaacaatctccagcggcaggggtaactagactattgtctccgtggaaaggtagcaccaattaactagtaacaaaatgactgcggtaacaacaaaacgttcgacatgtcaacaccaaaaaccacacacccagcataaccgtgaaccatgatttctactagaatgaatggcagttatgagaaagcaccagcggagacaaagattgaaaaagtaaaggtggcctcattagggagacaagtctctgggtaatatattgtaatactggtaaatatatagtttttaatatattttttaattccaaattccatatatgttcctatgaagctatttctgcaaatatttttttcaggaccgtacatcacaaaggcaaaagggccaggtcagctctccagctgagagtgaccacttcagagcagacggcagactccagggttagcaagcctggctgagacctggcccatgacaatcactcaacccctctgacctcaacatcctgtctgtgaaatggggataattactgcacctccacatcacagagtgcgaggcttaaacaggatgcttcatagaaaagcgctcaagaggtaacagccgggagggggtagtggttttcattaattaaatgttgccttcatccagccctgggccagctccaacacaaagcacacaccatccactcagactcagttgcctggattcaaagcccggcctggcctccagctgtgagattccgggcaggatttcccatctcccagagcctcagtttcctcattcatgaaacaggaagtgatcattccttttatttttatttttatttttattttgagacggagtttcactctagttgcccaggctggagtatgatggcgcaatctcagctcactgcaacctcggcctcccagtttcaagcgattctcccacctcagtctcctgagtagctgggattacaggcacacgccaccacgcccagctaattttgtatttttagtagagacggggttttgccatgttggtcaggctggtctcgaactcctgacctcaggtgatccgcccgccttggcatcccaaagtgctgggattacaggtgtgagccaccaagcccagttgacaactgcttttaaagacacctctggctgctgtggaaaacagcctggtagtgcctcaaaaagttacacatagaatgatcctatgaccagtaattccactcctacatatatacccaaaagaactgaacccctctactcatgtatgtacacatacaggtacacgcatgttaacagcagtgttcacaaagccaaaacatggaaacagctcaaatgtccataaccgatgaacggataaatgaaacgtagtctattcaccacctgacggaggtgagaggggccataaaaaggaatgatgcataaaaacgaatattatggccaggtatggtggctcacgcctgtaatcccaggactttgggaggctgaggcgggcggatcacgaggtaaggagttcgagaccagcctggccaacacggtgaaaccccatctctactaaaaatacacaaattagctgggcatggtggagggcgcctgtaataccagctactccggaggctgaggcaagagaatcccttgaacctgggaaacagaggttgcagtgagctgagattgcaccactgcactccagcctgggcgacagaccaaaactccgtttcggaaaaaaaagaaaaaattagccaggtgtggtggcgggtgggtccctgtaatcccagctctacttgggatactgaggcaggagaaccacttgaacccgggaggtggaggtagcggtgagctgagattgtgccactgcgctccagcctgtgtgacagaaggagactctgtctctaaaaaacaaaaacaaaaaaggcccgacgcggtgtcttacacctgtaatgccaacactttgggaagccaaggcaggcagatcatctgaggtcaggagtttgagagcagcctgggcaacacggtgaaaccccatctctactaaaaatacagaaattagccaggtgtggtggcacatgcctgtaatcccagctactcgggaggctgaggcaggagaatcgcttgaacccaggaagcggaggttgcagtgagccgacattgcaccattatactccagcctgggtgacagagtgagattctgtctcaaaaaaaaaaaaaaaaaaaaaaaaactaaacaaaagcaaaaaaaccaatgagtaatgttgtcaagtgaacttcatcccaatgggaatgcagataatttgtttaaaaggcaccatgcacactgggcaggctggcttcccctgggaacgtcttcttttgcctggattcccagttggtttaatcgggcgtagaacactttcttcaatccgggattcaggcacccctgctcagcacaaactcagtacaccccgcactctgctgtgggttcttggcactattaggagaatgtgagggggtgattcagatctatctctagtgggtgcatgtctgccactcccaggaacgcccacttctggcaagtcagtgtcagagaaaggccagctcgtggcccctcctgccttgagtcccaggacccgtgatcagtcctacccggagcagaatcaggagtttgaaaacccaagtgccaacaatctcattttaacccatgtaagcatatccaatatttatatatagaattcataacagatgtctgggcttccattccaatagcctatattttacactgtttatttacatggttacaccaaacaagactcaattcaaggtaacccaatcctttgctactataccaaaataagcaacattttcagtccatgccttatatatattcaccaagcattacactaggcctccaactgctcatcggagcaagctgcagcctggacacaagctagagattaatcagtcaggaatgatcctgcgtccagtgccagcatgatggaagagacagagaaacagaagacatcagggctccagagtcaaggagcctgcaggttagttgggcaggatatacacacatacacacacacacgcacacacaaaaccacccaagaagaaaaggtgggatgaatgcatggacaggtaatgcctggagcctggggatggataagctgactgcaggtggcccaggcaggcttcctggaggaagaagacctggctgtangtggggtangcangctttctaaatggggaaaatctggctgtgggtggagttggcangtttccgaaaagaagaaaagctgactatgggtacacctggctgttggtggaacangcaggcttcttggaagaagaaaatctggctgtgggtggatcangcaagcttcttggaagaagtaaacctgactatgggtggaccaggcaggcttcctagaggaagaagaccggctgtgggtgaaccaggcaggcttcctagacagaggaagatctggctgcggttagagtgggcaggcttctaagaagaggaagggctgactgtgggtagacctggctgtgggtagactgggcaggcttcctggaggaggaagagctggagcattgaaaaacaaacatgacttggtgaatgttgagcatgcccaggcctgatccccagaggcaattacgcactcaagttacttaattctactcacaatgcctcacaaacaacttctctgacacctaacacagctctgggcaccttctagcttcagctcctcaaagcagttattcacgctactaccctgcacacctcctcacaccccaaccccagggacaggagttctgccagatgccaaagctcctgatgccaaagcctgggtctgcttccgggctcctcttggtctaactgtccaccccgcatcggcatgatgtgcaaaaacaaggctttgcaatctgccctgatgcctggcggagcgagtccctcccgattcgtctccttcagaaacacctgggctgccctggtcctgttatacccccaacacattctacagtcagctccgcaagttccacaaagatcaacgctggcgtttttatggcattttatttacagtttttacaatataaaaaaggaaggatgccacagctcagccagcaggacagacagagatctatgatgcttctgctgcaccattgtttgtggtcaagaaagtctgttttcaatgatttattaaattgtggtgggagatggatggtggcagtggttaccagcaacatgaatgttcttaatgccactgaacttcacacttacaaatggttacgacgataagtgttatatgtattttaccacaattaaaaacaggtaaatgcaggccgggcacggtggctcacgactgtaatctcagcactttgggaggccaaggcaggcagatcacctgaggtcaggggttcgagaccagtctcgccaacacggtgaaactctgtctctattaaaaatacaaaaattagccagatgtggtggtgcatgcctgtaatcccagcttctcaggaggctgaggcaggaaaatagcttgaaaccgggaggcagaggttgccatgagctgagattgtaccattgcactccagcctgggtgacaaaagcaaaactctgtctcaaaaaaataaaataaaataaaaataggtaaatgcaaacatatggtatagtaatattatgggctattatgagctacaaaaaagaatgacttgggactacagttacagccctcattcaggaatttgttttaaatgtgggttggtcgctaaggcatgtacacaacattttgacgttcaaatattcctagatttggacagtgagcacccctctaagctggctcttctgtcccagaggtccccaccagtcctccagaacttctttgctttcttacacaataagatgccccatgctcggcttgtacctttccttgccccagccctagaaccagcttcttcgtggacaagctctgactcctttgggtggagaatggtattcagaaacccagacctgggctctggtgtgctcactgctacttggggtcattgcttctaggcctctctgctgatggaggtaggatatacacgtacagtcttccctcttcccagattccgtacttgagctcgcctacttgctaacatttatttatatcccccaaattaaacctcacagcacttctgcaatcactcactgacttgcagagtgtgaaaaaactgagtcaccatcacacgttccaaactgaggtcaactgaggccacaacgccccatcttcttgctccggctgtcgagatgtaagcaagtgtccttctctcggtctagctagtgccatgctttccacatcactgtgctttttgtgggcaattttgctgtataaaatgtcccctgcacatatgctgctgtgtagtgctcctaggtgcatgaggctgccccacgccttacagagagaatatgcatgagaggctttattcaggtatgagttatagcgtagttggccatgaattcaatgttaatgaatcaacaatatacagtaaataaggtgctttttagagacagggtctcactctgtcacccaggctttagagtccagtggtgtgaccttggctcactgccgcctcaacctcctgggctcaagtgatcctcccacctcagcctcccaaactgttgggattacaggcgtgagctactgcactcagcctaaataaggtgtcttagaaacacacataagacaaggttatgggctgagtgcggtggctcatgcctgtaatcccaacactttgggaggccaaggtgggaggttcacttgaggccagaagtttgagactagcctgggcaacatggcaagacctcatctgtatatttttttaaatcagacaggtgtggtggtgcatgcctatagtcccagctactggagaggctgaggcaggaaaatggcctgagcccaggaggtcaaggctgcagtgacccatgattgtaccactgcattccagcctggggtgacacagcaagacgctgtcttaaaaaaaaaaaaaaaaaaagccaggtcaggtatcgaacagttggcaaaaacgttgtgacctgaggctcacaggaacctagcccgatgtttcccctaggagcaatggttcagtattcaataattcagggttcccagtgactttatggagcataactttcaagaataacaagaaccaactgtacgtgtgtatgtatactcacacttttattttattttattttattttttgagacagagtctcactctgtcacccaggctggagtaaaatggcgtgatctcgactcactgcaacctccgcctcccaggttcaagtgattctcagcctcccaagtagctgggattacaggtgtgcccccacaaccggctaatttctgtatttttagtagagacggagtttcgccacattggccacgctggtctcaaactcctaacctcaagtgatccacccacctcagcctcccaaagtgctggaattacaggcatgagctgccgtgcctagcctacatacacttttatacacacatgcatctatgactatttctctatttctgtgcatgtgtgcgtggcagtacctacagtttcagctatgtgtctgggtactgtctcgtccaagtttgtaagcaccttctccaaagtgcaaagcctggcttgtgttactatccatatgtttacttatttgctcaatcaatttacttattagctccataaccagcttcccatctgctccagtagcctctgctgtcagtcacctctgcaccctaccccaccttgcttccggatgctggatgccaatcacccccgacacctctacatagcaccaccctcgacatgctgcttctttatttcttatttatttgtttgagatggagtcttactctgttgcccaggctggagtgcagtggcacgatccaggctcactgcaacgtccgcctcctgggttcaagtgattctcctgcctcagcttctcaaatagctgggattacaggtgcccaccaccacgcccagctaatttttgtatttttagtagagatggggtttcaccatgttggccaggctggtctcgaactcctgacctcaagtgatccaccttggcctctcaaagtgctgggattacaggtgtgagccaccgcgcctggtctgcttctttaaatgccaggcaccaacatttgtgcaatggggtgggaggaaagaacagggaggagagcacactgccggcccctgcactgaatccactgatcaatctgggggcaactgccatctccatctcctgtcttcctatccgtgaacatctactgcagtcctctccaatgtccttctgtaaagttgtattatgttttgcatacaggccttgcatattagttctcagatataatccatatactttatataaaattcaaaccacatttaaaaaaataaaactagcatgactataacggagtctgcaacattctcacagactttatgataaaacatgaaacttcaaagatacttagggtggggcagggacaatgtttaaggctgcctggaagcctccccatccctgagccagaaagtcctatctccccttcaaggggaaatgcttgaaaaagcactgatcaggctaaaatgacagggatcagggagtaatcaaagtacaagtgagctggtctcctccattctgagcacagcaaagttcagtctctccaagtccaagaatcatacacctgtttgccaagaatgaagttcaggtgtctacaagtggctgaaaatattcattgctgggccattaacaacattcttggcaaaaccataccttagcttctcgtggaaatttcttaaggtagaagaaacaggaaacacccaggctcgcttttatgtagacagttccatgaagccagggaccttccccacatccacgtttcaattacctgcacgcagctcacagtgtattcaacatctacgcgtctctcctactggggtggcggtggccactcaaaccctcatgcagctacgatgaccgcaattttggcaacataatttcatgtttttccttgggcttttacccaagtcagtgacacaattctgcagttgtctaaagattcaaaatgagggacttgacatttacaacaataataaaatcttgggtttcctttaaccaagcacatgttctgccttttagagaaagctctgcaaactcaagctggagtgggatacttgctgacatcttcaagcaccccaggaatagctctactcccccatttccaccttggctgaaccatctatatcccaccaattcccccaacatccctccatccgtccatccatccacccaaggacctgctaagccaggaggtctctcccatctaccccacagcctggcctcagcccacaagggctctctctacatgaatcccaccgcaccagagtagaccaagtctcccgtagactccaccctgaccacctccatgcctccagccattcccacccctaaaaaccctccctggtctctacacccagctgatgaatacttggctgaatgtgacctggcctcctggacccaggtgaagcccacgtcctccgtaagcccgccagctcaccctgcctctgcaccttcactggagagagcccgcacttcacctcctcagggcaggcatggctgatgccacccagtggaatctggtgcaaagcagggcccggtgcagagcagggctgcctgcagagcaaggccctggtgctggggccgagcacctccaatgctggccgtggaaccatccctcccattccaggtgctgtctccatcaagaatgagcgagctgctgacatttgcatgacaataatgaataaataccatattttgcttcaaatccagaatagatgtggccagggttggcatatgactgttgggaaaggacagtttgcctcttcccaaaccaacttggattataaaaagcttttcttaacgaccacaagagcggaggagctcaggggcagacaaaaggaaggctggctgcagaaggcgggagagtggggccttcaggggcgggtggggagagagaaagcctggagctgcacccccaaggtctgtgtacatcaggtgctacagaataacaccacctcttccagcttggcccccacctgccctctcccagcccagtcacccagacagcaccccactccccacacacacctcacatctgcccgcctcacactcaccagcttcggctctcaatgcaacctggaacctgcccttggcctctcagctcagccacccccattcctgttggcccctggccccccatcgaattctctctaatcctaatgcacacacttgcacactcaaacacacacacacacacacacacacacagcccagaggaaaaccataattgactgaggtccaggcaagtttcccgagcagggaccacatttcaaaggtcagggaagcaggcgaacaggaaacatacagggggcacgtttgggggtggagcaggaaataagaaatcacttgcaaaagataaaaagaaaatgaggtagctggtttcagacacctcggagcacacagaacaggacaggcgcctccgggtcttccctcaacagggagatgggccaggcaggtccctgctgctccaccgcagagctgggggctatggccctgacaccaaggccctggggcaggcggggaggcagctgttctcctgcctgtgctcccgggcagggcctggccccacaagggaactggccgaaggctctgcttggctactccggaaagtcctgggagacaagcaaaggacttgctaggtcactccaaacggcccagatgtgacaactgtgaagaagccacaccaaagcaaggtgacagaacaatgttggtgacgtcaggttatcagcttacgctcaactccacttacccggactcacccgtaacctgccgtctcttcccaaccagtaaaggatgcctaggtagaggggcacaaggcctggagcataattaccattttaaaggctctgagaagtcctgcggtgaggaagcctagttcactttctctcccctaggatttcccaactgcgcctgatcacagaacattttttcatttccactcaggaaacatattttgaaaaacactggcctagaggcagaagtgaaatggaaaacacaaaagtaaaactgaacaggaggcactgggcagagaacggtcagaggcgccctgaatcctggaccggtggagatccccagcttggcatgctcccctccctgggcccagaccgcctccccccatttcctggataagaaggctaatgcgcatcagggtgaagggcttgcctgggctacacccccaggctcgccccacaccaatcgcgctcctgcgagagccagtgactttcttgatttggctactgtggaattgtttgcaactaaccaccccagatacagatacaaatgacaggatgatcagatgtaaaggacccacaggtctctgtgatacggcttcatgcagccagcatggctagtgccgtgcagaatgagaatgaccccaggcaagtccttgcctcccagacccagaaccccatggagcccaccagggctggttcacaagcactgtctgggtcgggcagagattccagcaagaggagggaacatccatgcaccggagccagttaccagaagcaaatcgcctcttccaaaacccaggctattaatggagtccactgttgagtggagctggggtctagctatggaatactgcacagcagagatcttcctgagagaaagcagttttccctgaaagccatgtgtcctccactaactgtgttttaattgggcgaacgtctgtatctcattgcagtggccgcgcatgtgctgacaaggggctgggggcggggtggggagcagaagctcaggggcctgggagggaaggaaacaggccaccagggctccccagaaggcatgtatctctctcacaaacacacgcatgcacacacacgtgcacacatactctgcaagccctgagttagcaactgtggaatgtgaccagctcagtgatcccaggacaagctgctagggaatatgacatttgattgatgtctgcaaatgtgcgttttcactaattagaaggtttagggcagagcagagaaaaatatgtatttcagagtcccagtttgacctgccagaaaccagcccattactaacattcttattttcaacaaaatatagcattctgattacataccatcttggttccacgcctcctgccttgccaagcccccggaagcggcccaaggccatggcaaatagtgagagaaacagttccagggtggagactgactcaggggtgtcagtcagtggggcgctgatggccggtgggaggccagcagtcatcaccctctccttgggacagttgagtagctctcccccagggtcatgtggccactcaggttcatatgggaggcgagaggagtggcagagtccaggagagtggctccgaagtcactgttccctccaggcctcagtgtcttcatccattaaatgggtaggctgaggtctgggatgacaaggagggcttgcacttactgaaacccatgggaggctgttcgccgatttcttttattgatggaagaaaacactcgtataattcaagtaccaattaaaaggcaggcactggaaccaccgtctgccaattcctagttttgcctataccaaatttgagcaagttaattgacctctcccagcctcagtttcttcgtctgtaaaatgagggtagggatggcccccagcccacagggcagctggaaggattaaagaaatcaaacatctcttagagcccacctggcacactgtgatacacaacaaatgttagctatttttgtctatgaagtctagattttatatcttgggtgttctaaagcaggatacatttatttaaaaacaaggattttcattaaacacgtaccccacagacagcaaccccatggagactgctcttaattcaggccagtatcgaaacgactctaactacaagctttatacaggtctcttggctgtccttcaaatccaactaaggtggtacttctgaagcactgtgcacatgtgtgtgtgcatgcacacgtgtgggaagggcgggctcacggatccctcaggtaccccacccacgcagtctcaagtcacaaagcgacagagcagccgaggaaggtctgtgccccactggaccctcgtgaagccaccaactctacctctgcgccgtgtcctgcagactgggctaccctttgggtggggaccagcatttgatgcaagaaaggcagacagaaaaggaaaagggcaagttcgactccagataacacagacagtaccaagccccagggtccataaatgccacgcagatggaagcatttactgcgaggccacacagcaaacgcacggatccagggacggaggtgcagactgcggtgcccctgagccatgaccctgcaaattaccaccatgggaaaggaggctgccaaaccccccgacagtcggctgggctggcacagactcgtggtttccatcgaggtgggaggaggtgggacgtcccagcccctcccccatgcccactgcagagggaagcggccgtttcccctgtgtggttacaaaggtctcattgttcttcctcacagggaggaaactggaggaccgagctcagaacgcattttagaactggcagaaaagaacatctggggaaggaaacacatttcagaaacaaacatacctttgtaccagcttttattttctttaagtgttgaaaaaataataataataaagacatgccaaatttatcatcgctctacaaaatccctttattgagcaaaacgtggcagctctactttcaaatgattactgttcctggaaaattgcagcaacgtggatgccaaggcccgaaggccgccatcagcagccaaacaaaagatgccacctcgggctccgcgacactgtaccatgccagggaactggacagatttggggaatgccacggtttgcctttaaccccttgcctcctggtctcctgatgcatctcagaggctaacattctttgaggaactggcatttcttagttgtaaatatgcatgtgggtttgggagctgcctgcaaagtccagtgttgacgatcagctttgatttccttggaatcaagtttacgtgtcgagtctggaagttaagaagaatttggagaagctgagcactatggtgttgcaggccctgggtgaactcttccaccaagcattcattgtggactgacagcgtgcgaggggctctgcaggcaggtgcacaggacgaaacacattccgtccgggggaaacctgcaggaaagctccctcttcttcctaaggtgccgggcctagcttcatgggtccctaccctccacgcctgtcacactttctgagtctcatgtgggagctgcttctggttcctgacttcactcagtcctcataggaggtggaactactgtcaccccattttacagatggggagactgggcacaaggggaccaagaaaccaatgcaaagtcacacttgtgggatcagtgacaggggagatcaattcccaggttctttctgcaagagttaaattgttttcatgctgcctaagggggggcaactgaaagaccactgcatatctttgccaaaagggtcaagcacaggagccgcagccagtgggtcagatccgcagaggcgctggggtgaccctccccatacctggagggatgcttgtcccctcctggccttcactgggtcccctcatgaccgtggcctcccaggacctcagcacaatcccggtcctgtgctccaggacaagccctccgtccccaagactgtgaggaaatggaacgaagaggggctcgctgcagcccagcacccacactgccccttctcaggggcaagaaccgtcctggaggacttggctttggagggggagcctgggaggccagtaagtcaacaagcctctactgctcatgggtgggatcccaccgcaggcccccacctgctggggcgggcagggacgggcggcacagcttggccagggcagataacccccaccttggccagggcgaaggcaggacacgtgggctccagcctggccccaccatccctgcacaacactgggcaaagtccacgttttcctcaactgggtgttgacatctgcaggacaggggcatggaggtacagagcgctgaagccacacagcaacctaggagcgagactccatgcctccccggggacccctccccaccatgaggaccatgaaggcttcccatgtgccgcaaggactctggtgtggagacacacgtctcctacacagccaggcctaacgctcttgtaactgggtggtcccacctgggctcacagctggagggccaggagctcaaggcttcgcagggtctgctctcatcccagaggcgatggggagccacagcaggctgcaggagagagggtgggccccctccacttcagaggccccatctggcccacagactggagagcacatctctcagcaaccacggagcgccaactgcgcacagggcctggtcgtcagagcggggcaaaggcactgaccgtcacggccagggcgagggaagacgggtgggcagggaccttgggcagagggggaagaacctggtgcccaggctggccctgccttcagcagtgaagctgagtggggaggcgctgatgcagggggccagaaagggctgctggtcagccgggaggagccccccacagaggaagcagccagcccagacgcagatggcagggtcccctcaacaatgtcctctgaaaaggagaggcggggactgctctggtgacacctacaaatagatagtcagccctcagccccctgccatacttctgacaaagcagaggcccccaggggaggcgcacccgaaggtacctgcacctgtcccccagactcctagagcccacctgaccccatcccaccagggctccagctacaaaataaatgccgaggccagctaggcaaggacgcacactcggtaccgactgaataggctccacgttgtcatgagcgcaacccacaggccaccaggccacactatgcagagctgagatggtttcggccaagcagcctctcagctgagctgaacaagtccagagtccccggggggtcgtcactatggagtaacaattgcgatgcgatggtaaccctaacagctaaccgtcactgagccaggccctgagctaggtacttttcaacgctgcctctctgcagcctcaggacgagcctgtgggagcataaagatcattccctatcacggatggggaaactgagctctgaagcagttaacgtgcttgtcccagaccgcagagctaggagcaggacacaacagcaggtcaggcaggaacgggtgaggggggcctgcatgggcttctctggaggctgcgcatacacgcaacccccaggaccccgaccctgcacctgcagctcgctactgccccctcagtgactccagcaaacctcggggtaggggaaggaggctgggaatacctcgggtgtccgaaacagcagcttctgcttggaggccactgctgcataatggttgctgcccagcacaccccaagccacctgtgccacctgtggtgaccttccagcatgccttggtgaccaagctggccttaggtgctgtgggcagccaagaatagaacagggcccacccctcctcttcacactaacacaaagcaagaggcgggcacttcgactgagtgcatccctctagctcaagggcctcacggatcacaggggtcagggcaagatcccaattctgcattcccgtctgcctttcatcctgctctgccaacaacagccagtgaggctggggacatccctgaacctgtttctcacctgaaacacatcataccattggaccccagccctccgggagaggccctaatccctgactgtggtgagatcagatcactggttaagtacccagaagggccttggtcaggggctccaggggtggggggtgatgggcgtggtggtatcccgctctgggctatagtccaccctgatggaggaggtctgtggtcagaaccgggctgtgcagggcacaggagcccagagggacccccagagctcacctggtggtctctgagcagggctccctcaaccctcagagaaaagcacagcaaggaggccgcccagagcccagcgcctagcacccagtggcgtgccagacctgcctggatcctggagatctctcatcaccctccaagtcagtcatgcccaacccagggacccacagcccacggggccgtgaaggtgtgctgagtccaagaaggccttcgacactgggaagccaagtggcacctcctggtgtggagcaggcggaatcccaccagcctctgctctgccagtgggcacagctggacgatgagcagaaggggctgttgcttaataaacgtcatttccttaagaggataaaacctttcaaaacagatggaaatttttttttaattaaaactggtggccaaagagatggaaagcaccccttgtgcctccctcccatcgtgacccatcctctgcacacctcaagctgttcgctgcccaggtgtctcctgaggcactgggggcgggtgagaatccgtgagccctcggccagccgtggctctctggagctctgccccaggccatcagggcacacgccgggcaccctgggggccacacagggcagagcccagctgggtcagcacacagggccacactgggcacacaagtctctgagcctcccctgtggacgcagctctcactatcccaccccactaggtcccggggatctgtcccacagggtgatatgctgtcacagaccactaccagagccatggcctgctgttccgcccgcagccaggtagtcacttgctccacagggacaggcaacgccgcacttgggggctgctctgcggcaggactagagctccagcagctcagccctcctgagaaggagaactccatgctctaagaggcagacgcagcggacggcaccaaagccaccacaagcccacggggccctgcatggcaggtcaggagtccctgaccactcgctctttgtaaccagagctgcagtggagtctacgaggcaaggactgtgggcggcagtggccacagcaaatgaatgagtgtcccaagggagcaggcggctgcggggaggcacagccgggacccaggagtcctccggcactgcagcaaactccctgggccccctgagcagcgaccaggtggcaagtgcatgaactcccgggggcataacctgggagggtgacactctcttcgtgttcaaattcttgagaacgcattaaaaatatcactcagtcacctactctatagttttaactcaaaagtaccaaagtagccaggcgcggtggctcacgcctataatcccagtactttgggaagctgaggcaagaggatcacttaagcccaggagttccaaatgaacctgggcaacatggagggaccccatttctacaaaaaaagtgttttaaaaaattacctgggcctggtggtgtgtgcctgtagtcccagctactcaggaggctgaggcgggagaaccacatgaacccaggggaggtagaggctgcagtaggctgtgatggcaccactgcactccagcctgggtaacagagtcagactctatctcaaaataaatttaaaaagcaccaagccaggcttggtggctcacacctgtaatcccagcactcagggaggctgaggcaagtggatcacctgagtcagaagttcgagaccagcccagccaacatggtgaaactccatctccactaaaaatacaaaaattacccaggcgtggtggcgggtgcctgtaatcccagctactcaggaagctgaggcaggagaactgcttgaacccaggaggcagaggttgcagtgagccaagactgtgctactgcactcaagcctgggagacagaacgagactccatctcaaaaaataaataaatcaatcaaaaccaccaagactttttaatataaacatttattattccataattccttttttgcatgattaaaaatgtttatataaagtttcctgaaaatggtaagaatgccaagtgaaggctgcaaatgcccaagcccccaccgtggcatctcacggagtctgggccctaggaggctggtgggtaccacgtggacccgagacttcacagtcaagtccctttggggtacactgggtttcccacaccccagaaatatgggctcttactgcaggaccatgggggtcctcacacttggcccagaagctgtcacatagccagacaggtgttctacaacctaggctagagggagctcatgctccagcagaattcgagccagaggaggtaaaagatgggtaagatctgctccctggacagatgaggccttggcctcagaacagttactgatcatctaccagacatcacactagaggcagaggggcgcagacgaagacagcccctgtcctcaaggccctcccaggttgggtggaccatggaaggttccagacagatctggcaagagaagtgcccacaccaggggcagaagatgggcaggtctgctcagggcggcacggcctgccaggccaaaaagttccaacttcagatgctggagaatgggcacgactgtctgagaaagggaaggatgtgatgaaaactacttggagaaaaattaatctggccagagcataagataaatgggcaaaggggaggttccagaaagcaaggagaccaagtaaaagctgatgtcattggctctgaatctaggctttcactgaatatgcaccgcagggcctgtaggtaaagcctcagagcccagggagtctgagtggaggagagggcaggggacagagctggggcctgtgtctacagtgctcaggaggaataggcatggacgtcagctcggaggctccagctgaagtgaggaggcggccagggcagcacggccacgcccggatccagactccttttgggaagcaagttcgctctgggggaaagtttggagaaatggcctttacccgcagaagcaagccccagaacatatcttgctccaaaactatctcgtacagtgaggacgttaagcttcaggtcccctagaggagacagtctgctccttcctggggcagaacccaaggtggccagagcctggaaggcacccagcacccaggctggtgtgttccagcccaggccacacgctcagatagctattaatgccccgttgagcaatttcctgagagctttgccaggcaggtaccgcctccccatctgaactaatacaggggtacatcccaaggaagaaatgaaaggtgcccacattttgctctgggattaactagggaggggagtgataattaactcagtaattatatttgccatcgggctaatgctaaaattagtgtgcattagaatttctttcctgagcagacaccggagtgagttgggcagcaggagtggctcgggcaagtcggcacaaagggcacctccagagccttccacaaatgtcagcaaaacccacaaatgtcaaggccggctccactgcacccagcagatgaattcacttccacagcctgagaccgccagctcatcggaggccatttaaaatccagccctctgacacctgctggatatcaccatttaccgtccccagatcaagagatcaaagggtggaacctgataggacggctctgaagttcaccacaaaagcataaacgtgcaagcagagccaatacgtcttttgaaaaggacaatgaggtgggaatttacataactgatcttaaaatatgttctgatgcttcagagatggagacagcagcattccggtacacaaagacactcacaggcagtggagcacagtgaagggtctggaatcaggacccaggtgtctgtggacactacacataaaagagcagcatttacaatgaatggataggatggaccatcccaccaaggtgttggacaactccctattcactggccagacccctacctcataccatatacaaaaaaaaaaaaaaaaaaaaaacccagacagaataatgtctgaatgtaaaacataaaacagtaacagtcctggaagaaaataatggaggatatatttataatctggagatggagtaacaagggataggaaaaaagccatagggaaaaagtagagttatgattatatgaagcttcttaatatctttatgataatgtaccaccagaaacaaggatgaaggactagctacagaccagcagtgaaacctgaaacaaacagaacaaagaattaaagtccataccaaataaagacctcccacaaatctataagaaaaagataaacaggctggcaccgtggcttatgtctgtaatcccagcactttgggaggcggagatgggtaggtcacttgaggtcaggagttcgagaccagcctggccaacatggtgaaaccctgtctctaccaaaaatacaaaaattagccaggcgtggtggcgcatgcctgtagtcccagctacttgggaggctgagccaggagaacagctggaacccgggaggcagaggttgcagtgaaccaagatggcaatcgcgccactgcactccagcctggaggacacagcgagactctgtctcaaaaaaaaaaaaaaaagaagaagaagaaaaaagaaaagaaaaagacaacagaaaaatgggccaaggataagtgtaggcaatttgcagaaaagtaaataccaataaaccagaaatgagggttgtgcaaatcaaaaggtgttataatttttaaccaaactggaccaaagaaaacaccaaaaaccaaaatcttgtaattgccagcatcagagaggatataggaaagtgtgtgttctcgtagatgcttgcaggtatgaactgctacagccttttaggagttatgtatgtatgtatgcttgtatgtatgtatttgagacagggtctcgctctgttgcccaggctagatctgttgcagtgctgtgatcatggcttactgcagccttgacctcctgagctcaatagattttcccacctcagcctttcaagtagctgagactacaggagtgtgcaatcatactcagctaattttttaaattttttgtagacatggggggtctcccaattttgcccaggctggtctcgaactcctggactcaagtgatcctcctgcctcaacctcccaaagtgctgggattacctggatgagccactgtgcccggcctcaatatctttaaaaacagaaatggacacactctttgactaggaatgtatcctataaaaacacttatacacatgcagagacacacgagcaagcatgctttgtaatagcaatgaaggctggaaaaactcctcaatcaggtaaatgctgtcaagtgcacctgtgtactatgaaatggcacttggcttttaacaagagcaaagacagaaaagcaaaagtacaaagtagggtgtgatggcacatgcctgcagtcccagctactcaggaggctgaggcaggaagatcctttgagcccaggagttggaggccaggagctgggcaatagtgagaaaaaataaaattaaataataataataataaaataggctgggcacagcggctcatgcctgtaatcccaacactttgggaggctgaggtgggaggatcgcttgatcccaggagttcaaggccagcctgggcagcaaagcaagacacccatctcaacgacaaattttaaaaaatcagccaggcaggctgggcatggtggctcacgcctgtaatcccagcactttgggaggccgaggcaggcagatcacttgaggtcaggagttcgagaccagcctggccaacgtggcaaaaccctgtctctactaaaaatacaaaaattagctgggcatggtggcagatgcctgtagtcccagctactgaggcacaagaatcgcttgaaccagggtggcagaagttacagtgagccgagatcgtgccaccgcactccatcctgggcgtgagtgagactcctgtctcaaaaaaaaaaaaaaaaaaaaaacaaggagccaggcacggtggggtgagggagggcacagaagcagcgcctcttctgggggcacccccaatctctagcgatccagaggcctcaggatcctgaagggagaaaaaacgtgaagctccgtgctagaagagaccatagagattggaatcagctggttctattttacaaaaaaaggaaactgaggccctcagaaggtgagtgcctctcaatgccccacagggaggcagggagagggctctgagccctgcagggccctggattcttgcaatggggtggagtggagcctgtgccgcccccaccaggcaccttctcaggagaggagccgttgtcatatccttgaaggggtccttgagcccctcaaaaggctaaaaaccactttcctccttgagtgaaccttcacctcagtttaaccacaagaaaaactacattaaggcccagcgcagtggctcatgtctgtaatcccagcactttgggaggctgaggtgggtggatcgcttgagcccaggagttcaagaccagcctgggcaacatagtgaaaccctgtctctacaaaaaacaacaaaatcagctgggcgtggtggtgcacacctgaggtcccaactacttgcgggctgaggtgagaggattgcttcagcccaggaggtagaggctgcagtaagcggtgactgaatcactgcactccagcctcagcaacagagcaagactcaaaaaaaaaaaaaaaagcaggccgggtgtggtggctcacgcctgtaatcccagcaccttgggaggccgagcgggaggatcaggagatggagaccatcctggctaacacggtgaaaccccgtctctactaaaaatgcaaaaaattagccgggcgtggtggcgggtgcctgtagttccagctactcaggaggctgaggcaggagaaaggcgtgaccctgggaggtggagcttgcagtgagctgagatcacaccgctgcactccagcctgggcgacagagcaagactccatctcaaaaaaaaaaaaattaaatctcaaaaaaaattacattaaggcaaactaaaagatgtttaaaatatatatattaaattaaatacactccaatagagcaaatacgaaaatacccagaaaacacaatccccgcacccccaggacaacctcccagggggtccacagcaagagaccccaagcacgagagacagagaacagtgtccctgtggcggaacctctggcccatcaggctctattagaaaataaggctcttgccactgagagaaagaggcacagtcgcccagcagccacgggctctggcacaccacgagtcaggccagcaaagtgtcaactgccccctacaaggtgacaaactaggacaaactggaaaccagaggctggacctggagcacagggaccaccacatggggctggggaatgggcagggacctcagagcgccacccacatgcctaagagcagcgcgtatgcgcatgcctctgcatggcttagggacacagggagctccccccacccccaacccaggaaggcagcccccactacccaggtagggaacggataggaccagcaccccgttctgctcgtaactcagggctccaggccccctcgggggcaaccagcacagagctcagaccccaaatatcttcacccacctcctggtccccatctggacaagggtgctggggactggctctcagtcacaccctcggggtactcttcaaaggacagctggatgccccagggcaggagcttttggcccccagctccctcaccccagacaccagctcttgggaccccaccagcatgggcaaggtggacaccatcgtcccgattttgcagatgaggaaactgaggctgagggctggcacacggctctccagagctgaagagaatgcagagagcagccggagccagccggtgggtccctgaggccggctcgtagcaagccacagctgcctccgcccatcacacttggacctcactggccccaggacagccctccagggcggcctggcacagagcccacaccctgctgcttcctgaacaaataagtgaacaaggccaccaagccgaggacctggatgtagccccggctcccgccagggcctccccaacagactccccatttggagagcgcattaagtgtttccaaagcctcacaaaccacagatgtccggctgtctcacggcttctgtaacctgaacttggccctcactctgccctcccagcactcctctcagggcccaggcccctcctctgagatgccagcactgactccccaacttgtccccatcacctggctcgttcctgaacctcggcaggagagtctcaggccagatcctcccaccagccacctccaccaggatgcaggaggcatgagacctgctcgtgccggctgggagatgcaaccaaccaagatcaatccaatcagcggatgaactgacaaatataatgtggtccctccacacaatggaatattattcagccacaaaaagggctgaaataggccgggcgtgatggctcacacctgtaatcccagcactttgggaggccgaggccggcagctcacttgaggtcaggagttcaagaccagcctggccaacatggtgaaatcccgtctctactaaaaatacaaaaattagctgggcgtggtggcgggcacctgtaatgcaagctacttgggagcctgaggcaggagaatcacttaaacccaggaggcagaagttgcagtgagccaagatcgcaccaccgcactccaacctgggcaacagagcaagactccatttcaaaaaaaaaataaaaggctgaaacacccatacgtggtactacttggatgactcctgaaaacgttacagtaaccaaggaagtcagccacgaagacgcattgtaagattcccttcatgcaaaatgcccagaacaggcagaaccacagaggcagaaagtcgactggtgttcaccaggggatccggggagagggaacgggaagtcaccgtgtaatgggtatgggttttattttggggtgatggaaatctcttataacttgatagaagagagggttgtaaacactgtgaatgtaccaaatgcctgccttctatactttaatattttatattatataagtttcacctcaatttaaaaaaaaaacaactcgacacctttcacctaggaaagatctggctttagcttgcatttcctgtaactcctgcctaaagccttccagaagcttccgctgccttgtggatcacaaccagactccacaccatgatctggcctctaagggcctctcgcaggacaccccgagggtgaaggagcacccgtgggcccacctctgcatagctgcaaagcttctttccctgtcctcccctctacatgggaagctctgcccgcaggggcggggccttatctgccattctatcgcactcaaccctagcacttcactcggtagcagacaccaaagcaaaacagcaacagcattataccgggccaggtgcacgttaactcactgaattcatggtaggaaggattctattcccattttacaggtgagaaaactgaggcacacaaaggtagcatcagcttcctaagcctcccagcacaggaagcggccaggctggaatcagaccctgggcgcaggggctctgtccacagtgctaactaactactcctgcccccgagggctgcagcggtgagtgagtgagtttgtcagtggactggatgtccaaggtcatacaggaaaaatccagactattgtaataacagcctctagaccggctggggccagaaagatcgaggacgctgacacacaactgcgctcactgcagctctgccagggatggggctaaaggtctcacacagggcagttagggctccccatagcctgggagaggaacggggtgagataacagaaactaggtatggtgcccgaagtcaaacagccactgagcatgtaaacccaggtgggtctgaccccaaacccctccacccccatcagccctgcaacccgtcgctgcaagggagaaagcaactcagaggcctcacctgcctacatcccccacccgtgtgtgtgagttctactaaatgcctgagcagtgacacagcacggctgaaattaaacgggttccaaaaacgacaggaagcacgaagtgaatctccccaggaaagtgctgaacaaatgctggatcgggttcaccggcgaatttcttggaactgaagaggggagctaaacacacggggccctgctttggaggggactctctcagggtgctccacacagcacttggttaaccccactcagcccttctgggctctcccagagggcccggccttggccttgggcatctacaggaggaacctccagggggagagggggtgcctggacaggccggccctggaacaagcacttgggccccgaggagagaggactagggcttgggagctggggaagttctcagcactgggaccactagaacaaagccatttccgtgcgttcacagcttccaattgcaacaggaagcaatcaggaaaaataattagcggcccacttactggcttcgctgaggtccgaggcatgtatttcacacagtaaaaccagggatataacatcaaaaccgttctgcagaaagattcctccctttccttccattttaggcctggatcaccacattcactggggctcccaggccttgctgcctaatgttaaaataatcaactctatttttgcctcacacacaactgaactctacagctataattctttctcctcaggggctcgaaccacatggacgacaggcatttgactccagcaacatcaccccaaaacgtgcacaaaacccaaaactgcaatgaggtgaaaggcaacgcggtcggcctagaaaccccccctttaaaacaaacagtttccccaaaaccccttttgcctccttgacccaggcatttccggaaaaaggagcggcgctggcctgtactccccagatactgtcgctgttttgtcttcaccttgttttgctagctccagacaaggccccacaatgtaaacacgctcctgaaagaggcagatttggggtgaaactgtccatagaatctctaggcttgggtcagaggcaggaggacgtgaaacaaactccaagctcctcctgttccccgctgtcccccacacctccaagcagaggctgcagcctgggggatctgactacagggccaccccgctgcaccattcacactggaaatattcagggagacagctgtttgccttaaggaggcccagacaaaggggcccgaggtcctccccgctaaactgccacaaacagaacaggagccgcggcgtgcacaggcacttgcggccgtgccacttggccagccatactccagaaaaacaaaacacgcacatccgaagagaatgatttaggtagcaagaggcttgcttgaaaaaccacatggcaatctccaaattaaaagaacatgtgtagcgtttcacgactgcttaagtttcctgagtcctcctgacctcaactccaccccctgggaaacaccaaaagttggatgagaaagttcccccgccctacctctccccacgggagtgtacaactgaggcacaagcctgcctcccccactgccccgcgatctgggaccacgtctcctccgcgtagccgacccggggatggacactatctggggacccggcggccacacggggcattcgggtcgcccgggcacctggcaggtgtcagtccgcttggaaacccacagccacgcggctcacaggagcagcgccaccggctaggccgccccgcgcccgggctcagaactttctcgctgccacttcagcccgtcctcggagcacgcggggcggccgcgcggccgctggaaacaggcttgcgaaccggctccccgggccaggcccgcctccgcgccccaagtccccgctcggtgcccggcccgggccacacgggcccagcgcgggctcggctcggctcccggcttcccgcgggctcgggcaggtgaggacccgcccgcgccgcacctggcggagcgggcgccctcctcgccagcccgggacgcagcgtccccggggagggcccgggtggggagacaaagggcccgcgcgtggcggggacgccggggacggcagggggatcccgggcgcgcgccccaactcgctcccaactcgccaagtcgcttccgagacggcggcggcgcccgcgcacttggccgcggggccgcccgggccattgtccgagcaacccgcggcccgtcttacacgccgggcgcgggaaggtatcgaatcagg

SEQ ID NO: 8 - DNA, 33769 bp, Homo sapiens
  unsure (33739),(33749),(33758): Identity of nucleotide sequences at the above locations are unknown.
cttccccttacactggtccttcgacccgcctcggatgaaaactgaatgggtttagccttagaggctctcggtctctaagggaggtgggtcaggatgccggggacagggtcctcttcctggggcaacgtgggggaacgagccacctacccctccactgaattgccctggggtgtgggtaccgacggctcattcggtgtccagggtctgagatgtgttgacaggaagaatgaaaggggatgggagggatggggcgaaagaagccacctgcagccccaggaactatctggccagcacaccgtcacccagcggcctgagccacccctgccagagccaggaggagaccctgccaatgggtcaccagtgtgcaggaactcagaaggtcatcacagttaataccctccatgccccaatgtgggaaaacaggttttttcacaacaaacaagataatttttgttattttggcaaaaggaggcagggcagccccggacacctccatcccacctcatcacccagccgcagggccccggccatccctgcagacagagtggatgtcacaacctccctgcaccgaaccaagtgcagctcccaggccacaggccacccaggaaaggtccagtggcccccggaggctcccaccgcaggcctcccaccacagccggcaccaacccaggatagctgtgttctcctggcttcttttcacacgggtagcagaaagctgagatccggggaaagctgagatccagggaaagctgagaatcggcctctgctgcccggacgcccacccccagctctgctcccagctccagggcctccttctcaggtgcccttacaggaggcagagggcttgagccacctcctgggcctggggcacgcaggatgaacggggtcacggtgcaggccactgtccactgcgcagatcccaaggccataaacagcctggccacagtggcttcccagctggcaggcggccagattatttttgttgtttagcaattgattaagtttctccgctgcccccaggggtaagtggtggggcaaatgccgcaaccgcagcatttgacccgggatcctgtgccaagtgaccatagggtcacaaagcacaagggaagtggctgggcccgatgctggctctgctggaacctgaggccggccactgtcacctgcacggtgcctgggaccttccagcaagcacagagaagctatggccctccaggagcagctggcaggcaccttggcctgcagtcaggggctctgtctgctcagctctaaaacaggaaagtcgctgctctgcctggggtcagggcagccagagagtgaccaagtcagtgccggcctcaggaagggacctgcaggcgggtcccttcctctcccatccctcggtgccagccagcccctcctgtggccccccactgcctgcctctgcccccatgccccaccacaacctcaggcccatggctgcatggccactccccaggcaggcagtggggatgggatttcaccatgttggccaggctggtctcgaactcctgacctcaggtgaggagttcctaaagtgctgggattacaggcgtgagccaccgcgccagccctccctgtggtactaaacactcacacccccttgctggggaccctggtgagggaacacagcctcacaagtgaagtgtggttttgttgagcaaatgacgcctgggcagccctctcatctttgcctaaaactgaagaatttaggggcgtggatgtataaaacagttggtgacttaaatgaaaaagaaggccacactcccccctttaggcaggcggcctaattctttaaaagccagcacagggtgcctttctgaacccaggcacacagtaggtgttcaatggacagcagcggttacttgtactgctcatgacaccctgtctgtggcctctgcagctggctccagcctgacgcatggctgcgcccctccgcaaggccaccccggtatacatggaaactctgtggagaaggccttgggggccggccaggacgccaggcccagatcccatctgcgcccttcctccatagacctcagcgagctctcggcaccatgtgcctcaggcccatttaagaagtagggccggccaggcatggtggctcatgcctgtaatcccagcactttgggaggcccaaggtgggtggatcacgagatggtcaggagatcgagaccatcctggctaacacggtgaaaccccatctctactaaaaatacaaaaaataagccgagtgtggtggcgggtgcctatagtccaagctactcgggaggctgaggcaggataatcgcttgagctcagcaggcagaggttgcagttagcggagatcgcgccattgcactccagcctaggtgacagagagagactctgtctcaattaaaaaaaaaaaaaataaaaaaaagaagcagggccagccacggacgacccctcacacagctcccaggacgcgtgcctgggtatagggctcaggaccatgaccgctgcagtggcccccaagaaacgttacttttgtcacccaccccgcctcagtggcagtagccaaaataacggattagaatggaaccatgtgacaatgccactgccccaactgacagaagatggctatcagcagttcacgcggccccacctatcacaagtgcagggcactctacaacttatgcatccttccccagacaccgtcctttcgaccctcccaggtcagcaaggcacacagggcctacatttcacagccacacagcagagggctgaggctggaactcggatgctctgatttccgttcaatcacatccccagaggtggcacagagacggggggcttctcttgacaaagtcaagaaagtcactgccagctccactgaagaccaaagaacctcagctctcaaaccctcttgaaggtgttaccgaactctcccagcctgtttcctgggtcccgatgttggtcccgtgggacacaggaagaggaagaagctccctagagcagagcctggtgcacctgccacactctcagagggctgcgcacgggcggaggagccgtgtgcaggagtggggtctggatggaggggcgctgtggccgggggcagggggcaggggaagggtgctccaggtggtgggcacagcacgagcaggggcagggaggtccacactcagatgtgcacagggagaaacaaatcgtgcatttccattggaataggcggtaaaaggtagaaaaacagagtgggggccaggaagggagtcggagccttctagtgtctctctgcaggtgagcggcagcccgaggtgtcagctcagcagacttggggtccaggggccgtgtcttctatcactgaccccagggcacacggaactggggagggagagcagaggcacagggcacggtcagtgaaacgaaacaaggagtcatcaccaaatgcggaaagggcaaggagtgcccgcagccgcacaagggttctgtctgggcaacgtgggcgtcccaccaggccccgcaccctgcaagcgcaaagctcgccactgaagataaagggaagctgttggagctgcggagctggtctggggtccgcatggagctgggcttatgctgcagtcacaagggggacatggaagaggctgcaggggacaaaaccagtgaccacagtctaactctgagcctgtggaaaggcgcccacagcattcacccatcccagagatgccattccccctgtgcccccgctccacggtgacagcgttctccaggaatatgatgcgcccctctcctcttgcatcagccctgacagtgagtattcaggccaaaaagcagaagagcacagctgcgtggttccatttccatgtagttctggaacaggcaacgctaatccaaggtgatagaagtcaggagagtggtggagggggcgggggttgaggatggcaaaggggcaccgggaactttcccagtggtagaaatgttctctgtctggaccgtgtggtagttatgcagacatatgcagctgtcaaagttaatccaaatgtacacgttaaaatgtgtgcgttttattgcctgcaagttatacctcaattaaaaaaataaagttagcactcaggcttcttccacaacttcctgaaccgtgtgagctgattttcttgctattaaaaattcacggtccatggctgagaacagcagctgccttctgtttgcaaagtcaacgccaatcactgcccggccgcggcagactcggccccacaggacctcctttcttttttccctttgacctacttccctgataagtgacaagacagccagactctgggaacaaacgcccgttattcggccccgagctgagcgggccctgcttcctgagctaatccgcccggacagacggagggacgtgaggggctttgccgtcggctccagctgtcagtctgcccgtcagactcgacagtggccccctctgttcctcccgctgcccccactccatccccgacttctttttgtttcctgtccctgacagacgaacatctgttaaaactctgtctgggtgagctgtggccagcggcccacaaatccccaagccgcaccccagcctcatctgggcgctgccgggagcactgcctggccaccctctggacatagctctgagagccaccggccagggcacgtgtggcccgagtggcatggtgcacgccgctaagcccactgcccaaaggcccccaagcaggagggatgtgcaggagacaaaagtcaaaagaacaggggcacgttccacagaggatggggctggaggggtggcagtgaggaacagcagcttccgaggatggcggtggcaactcccaaataaggcctcactcctgctgtttttagctcattccacataattggaaaaacatggcagaaaccgaagccagctgctgccttggtcctggggctgtgtggagggggtggggaggccggaggcccaggctctgcactcgactgctggggatgagagtgactctgagctgcagagagcagcatcgcagccgccatggtcccattgagccccggccacgctgggcggcagaggctcgtgggatatacctgccctgtctcatgggggtcacttcaggaggggcgggggagccaggacacagcccagggctagcggtcaccctgcagctcaggggccacgtaaatagtgccaccttgaaggcacacagcagtgcggggccccccccgccaccaacgcatccctacctctaggaggccgcctgtgtgcccctgggaacgctgctccctgtcccttggggtcctggtgtgaccaccctctcagccccttccttggggaaggcacctgactccctacacccagctggctttcatttgctcaaaatcaggaaaaagcagaattcaagacatcacagaaatgtcttcgcctgtaactccatgaaagataaacggtcagacacccaggagggagtcccagggacccttgagtctcacctgaggctctggcttcaaacctcgagatgtttccagccatgctagcgccgccccccacaacctgccccacacagtcctcccttgggaactcacagatttggcccccacctgccccgtttcttctggtggagtgggtgcgttgggttggggtggggctggggactctggatgtgtcttaagagtctgagtgattctgacacagccaggccctgcccccctcctgaccttcgccccacaggaaagggagccacacgcctgaagcgcccagcacacccccctccgtcctccccaggtcacccgctggccgtgtgagccgtgctccccactgccccttcacccaccccagctcctcctggcagcacccagccttggaagctacttctgattacaaccgccgaaggaagactcgctccctcggcactgacccagacagcctgcaccatcacgctgctcagcacaacccacacagccttcctccaaaccccatggagcggggagtataatcaccccctttctaccaacggacaaactgaagcacagagaggttaagtcactttcctaagctcccaacacgatgacaaaaaatagaaggtcagcccgcaagtggaactaggtgctccaagtccccggtctgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtctgcctgacactgcacctcctcaacaccaccacggtcccgggtctgcctgacactgcacctcctcaccaccaccacagtcccgggtctgcctgacactgcatttcctcatcaccacagtcccgggtctgcctgacactgcatttcctcatcaccacggtcccgggtctgcctgacactgcacctcctcaccgccacggtcccgggtctgcctgacactgcactttctcaacaccactccttggccggctcccaactacaaaccaagccatgtcttccatcctgaatcctcttggcctaaacatcactcacaatgcctccctcgggaacaggcacaagtcccaccagcacagcctccttcgttacctgcgtttccgctagcccagggccagctccagagccctcaccacagagcctctatccttcacccccggacactggacctcaccaacccatagcctggaggagatccctgtgtgaccccagggcctcctctgcccgactctgaatttcactgcccaacgtgacacctcggaaggctctctgggcactggcagccctccatgggcaccgctccttctggccagctctgacatcccggctggtgaggtgccctgcacgaggcctctgcccactgggacctcacagccgtgctgtcagctgcaacaagcgacagaatttcacgttttcttcacgttgcccctgggtgagcagctccaggtagttttcagtcgaggcgaggcgtcccgtcagcagccaggcggcacagctaattcatgcccgccgggcgcacggccgcaataccaatgggcacctgcagcctggaaagccacagaggaaccgagaacagcgactgtgctcaggtgacaggactgtggtcttttaacaaaacattttcctttaacgtgatattttacggcaaggaatgaaacctggagggcaggacatttggatactaaagccccaggctgccgcgtggtctgctttgtgaagtctgaagcccgcgccccattctggccccgctcacaggtccggctctgactcaccagcttcaatgctaggccgtgcctgtcctccaaccagaacatgacttccttaaggacaaagccgtttctcgcccatccccatctccctctggattaagaaatatgggaagatcttctagaaccacctcaaatttgcagagagccatcctggtgacaaacccttgaaatgcttctaagaagagtttaggtttcttctcaactctaaaacctctagaaaactctatttccacaccagctgcccctggaacacttcagcttcaaaagggcccagggcagggagacggaggagccagcatccacaccgagcaccagcctgttaattaacgggaagcgggtggggcccatctccaggcagctctgaggtcagactggggaaccatgcttacaaaaaaaagtgaactgaaacgctcacgtcctcatgcaaaaccagactcccagttgcatctttctgtctcattgaggagctttttcctccctttgacagaacaccctacacacggcatctggaaccaaagcagaaagattcaggctcagagtaaaacagtccccacactggctgcatgtggacgttcccggcccagagtctcgcccaagcagggcctataaatgacacaaaatgtttttctcctgcgtgccagtcatgctccaactgagttatgtgtaaaagtgcctctcacggctgagggcaaaaacagttcccacaagactagagaaaggtgacccctgacggctgagtctctagggagcgtggagctgcgtgctcagccctgcggccctgacggctctggaatggaaaagctatccaactggaagggcagggctcgctgctagtccagcggtccaaccccacaggtgtctgtggtgtcagctccatgccacagagcccagggctggggccagagccaccaggccccctgccagcctgcaggggcctcctcctctgggtagcctaaccaccccctgtgagcgcaggcagcctcctctaatcaccacagggcctgtccccccctctcccccgcttgcaggaaaatgagccctgaggactccccagggctgctctgggcctggacatggagactgggaattacatttgcagaaggagcgcaatgcccttgaagggctcagccacgagcagccagtccccagggctcagaaggcccagctgttagaaccctgggagccagcaaagagccaggggctccacctaagtctatagcccctgcctcttctggttgggaaagaaatcaacgcccctttactggctcccactgacagcccactcccccaggtatgggaggattctgggacgatgcaggcaaacctggaccctgagtgaacctgccccagctctcacgggcctggcaccagccacagcacctaaggcgccggtcatggtgacaacatgaaggtgataagggcatggacagtggacatggcagctggacactgggcacccactggatgccaggcacccagcacggctccgtcacccctggatgagcagtggccctttgcaagccagggtagcctgggcaagttatttgggggtctccaagcttgtccagctgtgcgacttcactgagccatgagtctgggattttatcagggcccacacccgttcctggaactctgatacgtgagggagccacacagggacccttaacaaaagctcccagggcaacatgttctcttgcctcagtctcccaaatagctgggattacaggcgcacgactaccgcccggctaatttttgtatttttagtagagacagggtttcaccatgttggccaggctggtcttgaacccctgacctcaaatgatccttccactgttagggcaaggcacctgacaggcacgactgcacgatctgcttgttgggggctgtgtccattccccactccttcgacaaatgtccacacccagccttgctttgacaccccaagaacagagatggtgacacctgcttcctacatgcccattgctctcccaaggcagacatccccagcagatgcaacacagtgtttaggcagacatcaccaatcgatggtggcaacagacaccaggccctgctccctctaactccagtggccaggccccaagccagctctcacctgcccactcccaacccacagcagcaagactcagaaatggcaaaaacacaaagagaacagaaacgccccatagcgggaggatgactaaaagacatgtcttgataagatattgttcaggcataggccaggcacagtggctcatgcctgtgatcctagaactttaggaggctgaggtaggtggatcacctgaggttaggagttcaagaccagcctagccaacatggtgaaaccccatctctactaaacatacaaaaattagccagacatagtagcgggcgcctgtaatcccagctgcttgggaggctgaggcaggagaattgcttgaacctgggaggtggaagctgctgtgagccactgtactccaacctggacaacagagcaagactctgtctcaaaaaaaaaaaaaaaaaaagatatccttcactaaaactcatgtctttgatacatatttacctcctgcaatcgcaaatgcttctgcagtgcataaagtgaaataaatagcaggaagccttacggttcgatcacccacacagacacacagtcacatacaggaaaaacgcagggagggctggggaacaaaaaaacagaagataaaatgtggagacagacacaccaagagagtaagagaccacctccagacctcccttcagcttctcaaacacacgagccgggcccgttacagaatttgcggggaccgctgcaaaatggaagtgcagacagccccttactcaaaaggtaggaatttcaggtcaacaacagagctcacctcatatgactacacaggtcacacagcccgtgaagtcggtcccaacaccagcatgctcctgcctcaaagccgctgcacgtgctgttccttctcgcctttccctcttttagtccttcagatctcaggcctcctgagagagacctctgacctgccggctcaggcggccacacccccagtacaggagtctccggctcagcccctgctgtgttccgtacccgatccaggtctgtcctatgtccatctgtgtgccggcttgcttcctgacatggcccccaccacacgtgtgcctcggggcaggggaacaggcccgtctcattaactgctttcttctcagatattttctggaatatttgtggatattgggcaacatatatgctccacctttttcagactagccaggacgagctgcatttttttttttttttttttgagacagggtctcactctgttgcccaggctggagtatagcggcatgatcttggctcagtgcaacctccgcctcctaggctcaagcaattctcctgcctcagtctcccaagtagctgggattacaggcccgtgccactactgcccagctaatttttatatttttagtagagatggagtttcaccatgttggccaggctggtcttgaactcctgacctcaaatgatccacctgccttggactcccaaattgttgggattacaggcgtgagccactgcgcccggcccgagctgcctgttttacacctttgccatattccggtgattctctctcccctccgtcccccggccctgactgtggtggccactccctgccgtcatgagcccgtatgtcctcactctttccctttccgccaggacttcaaccaacactgcagagcgcagggtccagctccagcactgagttcagcctcttctcaccaacagacaggcaggaaagaaaacaaactctgagaaggccaaggttcccgggcagccagcaagccaagcatccttctccgctgaggcttgtgcagccgaggcaccccctcctccagggagcaggcagcgtcctggggcagtctgcgagggagaccagggcccttgctccaccagggccccaggtatgggggcagcagcaaactcatggctctgggagccagaccccacctgctagaacctactatgccacctgctgtgggcaaccccaggctggtgacttgccctggcctcctctgtaaacaaagggctcatccaacctggtcaaaccactcctccccttcaagggtctataatcctcccttaacctgcttggtccaaacccctggtgtcgccaggtcactcaggaggcagctcatctggactccttccctgggtccagtttctctctcaacattgcctttgaggccgaggtgaacggtcaacagcgaagggccccagaggtgatggaggagcgggtgtccaagacactcaccctttctaatgcactgactccctcgtggactcacttgtgccgtctcccccacccacccagccccagagcccagagtgcgagcgccagaggcccgggattctgtctgcaccgcggggtccccagtgcctcggagcaatgccagcacccggcaagtgttcgacaaatgcctgctgaatgagcaaatggatggatgaacgaatgaatgagcaagcagatgaatgaatggggtgctgtccagagccgtgaggactaggccgcccaagtccccatttctcaaattctccttctcccgacttgggaaacaagatgcttggtcggggaggctctccaaccatcccctgcagcagccggcacagcggacagaccctttgatgtaacagccatgtcttcattaaagatgccctgctctcagaaagagaaagacaaatacaaacctggaaaatcctcaccaaacgcaggacccctgccagggagcagagaaaagacccacacgccacgggcgccacgaccacacacacaccccagccgctgcacacaaacacagaccctagccagcaagaacagggggaccaggaaactgttcctaaagtcaggacccccatgtgctcagacagcagtgagagcaaggacacttctccatccaccggatgccaggagagtccttttagggggccccacaccgagactctgcccttaggactgttcctgagtgtggaagccagcccacttggaagccccctgccctcccgagtgggacaccggcacaggaagcaggccctgtcccccaccactttctgcaagctgggccccatcacgctacagaaacggggaggactggtcccagggatggcgctttcctgacacctctcgttaccccctcgcttgccaggccccagggtcagccccagaggccagactggctatcccaggcccgggagcatccccgaaggcgagctgcatcctgaacgtgtgtgatttcccgaagggcccgccccgaaccgacacctggaaagaaagatcctcagccggtgccccagaggagaagagccatgcctcactgcaacacagtcccaggaagcaccaagtgcctgaggaccaaggcggagagtaaaaaagtggaaaatatctggggcaaaaataaaacaaaacaaaacaggattgacctcctgggctcaagcaatcctcccaactcagcttcccgagtagctgggaccacagacttgaatcaccacacccgccaagtggatcatttcgaacgggtttgccgaggttccttctggggcacccccggcggccgcaacccattcccgccaggccccgccccgcccgcccgccccgtcccgtcccaccgcctcacctgccttacacgtcctgccgttgtcctgcagctgcacacccgtggggcaggcgcatgtgtagaaaggctcgcttggggacagcaggcacaggtgggagcagccgccattgtcctcctcacagcgagtgtggactgagaaaaccaggacagactgagagaaggttccagaagaggaccgtcacttgtttctgaatgagtcacatcctgcctcgtcccccgtgacagcctccagtgtgtccctctgcccaaacatcggcctcaagtggcatcagggacctccccgcgggcaccattccacctgcctcatcgctggccccgtccacatggggccctcagcctggccagacggcctgcaatttccccaaaaccagccgtgaccttcctggccaccctcacacccagatgtgacctgcccatggagtgacatcctccccatctgcttcctcccaccaagctcctatgactagaacaccctccccagctcctcggagcccccaaaggacacccctctgcaaaggctgccccccacgctccaatggccggggtcaggacctgcctgtgtggtagtgacgggaaccccagagacaatgggctcctgggcaaaaggcttgtcttgtctttgtgctatgtgtggacccagcagcttccataggaacactgtccttcttgctgggatggccaagcttgtcactctcccaagccctcctatgaccaacagcaattgaacggaactcgataaatgcttccagcacctcattcaaaccaggggaaagctgggtgtagcagccccaaaatacggatataactggaacaacaaactcatcaaaatgaacctctccctccctcatgctgccccaagtgtagatgggttttgtgaccacgactttctcaccaggaaacagctccagagagccccaccctcctgtgtcctgctctgggaacagctggcacccctaggccccacatttcaattcaaagtccaaaccttccataatggcctggccagaaatctccatccctggtccctgtgggagtgggccactgtccccagagccgcagccccactgtcacagaagctggtgcatttccccatcagggacctctgtcacaacccagcgtggcccccaggctgagaactgctgattctgggcagattattcattgataaatacgcgacttgcagggccaagcatggtggctcatacctgtgaccccagcactttgggaagtcaaggtgtgaggatcactggagcccacgagtttgagacaagcctgggcaacgtggcaaaatctctcatctctattaaaaatacatacacacacacacacacacacacacacacacatatatatgtatatataaataaccatatatatatatacacacatacgtgtatgtgtatataaatacatatacacacacacacagacaacttcttctgggccttgaaaacgaggcaaccttccttggaaatccccttgccactgctgagcctgaaatagcccccatgagctctgcagaggggtcctctgcaggcccgtgtcccccagccagccacacacctccctccattgcagcaggtacccctttagagagggggccccccagagcatgggcttctgcagggaggggtcacctgcccccccaccccacccacgcccgcgcacccccacgcccccgcatcctcccactcccctgccccgcgcccccgctccccccagccccctcaccctctcccccgtgccccaaccggcactcacaaaaaggctgccgctcctggctcagcacctggatgtccatgggtgagtatagggcactcaggatctccttcctcttccccccagtgcgcttgttgcaggcatggatggagcgggtctgccagtctgtccagtacagagtgtccccggagagcgtcagggcgaaggggtgcgtcaggctgccctccaccaccttctgcctgcagtcagggaagcggggtggaggagccatcaggagggtcccccgacagtcattgctgctgacccaattaatttctttttttttttttgagatggagtctcggtctgtcgcccaggctggagtgcagtgatgtaatctcagctcactgcaacctccgcctcccgggttcaagcaattatcctgcctcagcctcccgagtagctgggatcactgatgcccaccactacgcccagatgatttttgtatttttagtagagacagggtttcatcatgttggcaaggctggtctcgaactcctgacctcaggtgatccacccacctcagcctctcaaagcgctgggattacaggcgtgcgccaccatgccaggcttcccatttgctttcaaccagacaagtgaggccaggtcaagagccccaggagctggcgccctcgtacatttctcccggcgtgcacagggcacctcccaaacacagcctgtgatggtgacacacgggctcccccaggtcaagtggcaaagtctcccccagggaagaaaggaggaagccatgcctggcaaaaagcacacctctcctgcccaacgctttaacctctgtatacaaatcaggccatgtgcactcgctccttcttacaatgctcataatttatactttcagagtaaatgaaacttggcatcaacccgagaaacagctattcttttctagatgcttacagtgcccagcaaatgaggactcgggtgtaatgagattatggacactggaaacaggatcataatgtgacgtggtcggtaatgtgcagttttatttgcttaatgaccctcgccccgtgacaggctccctgagggtgggcctgggggcagaggtccccgccacgtccccagccctcagcacagttgccaggagagggtgacactcatgaagtggcacagggaagatgggagctgtgggctctgcagatccaccacctcttctgttcatttttgttgatgctgttttttaagaaaattattgaagtaaaattcacaggacatacgtttacttttttttttttttttggagatggggtctcactctgtcacccaggttggagtgcagtggtgtgatctcagctcactgcaacctctgcctcccaggttcaagcgattctcccacctccgcctccagagtagctgggaccacaggcgtgcaccaccacacccagctaatttttggggggtatctttttggtagagacagggtttcgccatgttgcccaaggctggtcttgaagccctgagctcaggcgatccacccgccttggcctctcaaagtgctgggattacaggcataagccactgcacccagcctaaatttaccactttaaagtgaatagtgttacctagtgcattcgcaaggcggtgcagcctccacttctgtctagttccaaagcacttccattgccccacaggcaaaccccacacccggcagcagtcatgccccagtccccgcccccagccccggcaaacacttttgatggacttaactacacacattctcaacatctcatataaacggaatcacaatatacagcctctgatgtctgtcttctttgacttggcaccatgttttcgaggttcatccaggctgtagcatgtcagtgcttcatcccgttttaggggtgaaccatattccagtgtgcagacagaaaccaatctgtgcatccattcacccactgggggacctttgtgtcatttccaccctcggctgttgtgcacagtgctgctacggacattactgtccattcacattttgtgtgaagacctgttttcgattcttaagagtatacagctaggagcggaattgctgggtcatacgtaaatcaatgtttacgtctcaaggaatcaacaaactgttttccacaatgttgtcttttttgtttgttttctgagacagggtcttgctctgtcacccaggctggagtgcggtggtgtgatcatggctcactgcagcctcaatctcctaagctcaatccatcctcctgcctcagcctcctgagtagctgggaacacaggtatgtaccaccatggccagctaattttctaattttatttttttttgtttttgtttttttgagacagagtctcgctctgtcgcccaggctggagtgcagtggtgccatctcagctcactgcaagctctgcctcccgggttcacaccattctcctgcctcagcctcccgagtggctgggactatagtcaccggccaccacgcctggctaatttttttgtatttttagtagagatggggtttcaccgtgttacccaggatggtctcgatctcctaacttcatgatccacctgccttggcctcccaaagttctgggattacaggcgtgagccaccacgcccgaccttacttttaattttttaattttattattttattttattttttttttttttgagacagagtctcgctctgtagcccaggctggagtgcagtggcgggatctcagctcactgcaagctccacctcccaggttcacgccattctcctgcctcagcctcccgagtagctgggactacaggtgcccaccacgatgcccggctaattttttgtatttttagtagagacagggtttcactgtgttagccaggatgatctcaatctcctgacctcgtgatccgcccgtctcagcctcccaaagtgctgggattacaggcgtgagccaccgcgcccagccttttttttttttttttttttttttttgagatagagtcttgctctgtcgcccaggctggagtgcagtggcgggatctcagctcactgcaagctccgcctcccaggttcacgccattctcctgcctcagcctcccgagtagctgggactacaggcacccaccaccacacctggctaatgttttgtatttttagtagagacgaggtttcaccgtgttagccaggatggtctcgatctcctgacctcgtaatccgcccgcctcggcctcccaaagtgctgggattacacgcgtaagccatggcgcccagcccatgtggccatttttcagtgagagaagccagaggcccatcactctcggttgctccctgggccatgctctgcctcagccagaagcactgagggaaggtcagcctcggcccttgccccagccacagtcacagataaaggggcctgcacaggtctgtgtggctccagagctcgtcacccaacacacgacgcttccatgtgaatagccccaggtgcatcatgaagagcgatggccgctgcagaggcagaagaatcccgcggggaagcaggtgggagagaggctgagaacagaccagaccctggagctacagaccctatgttccaaccctggctgggactagctgtgtggctctgggcaaattcacatgcttctctgtgcacaggggatcaaaatagcaaacacaggctaggcacagtggttcacacctataatcccagtgctttgagaggccgaggtggacacatggcttaagctcaggagtttgagaccagcctgggcaacatggtgaaacctcgtctctacaaaaaaaataccaaataaattagccaggcgtggtggtacgtgcctgtggtctcagctacttggaaggctgaggcgggaggaacacttgagcccaagaagtcaaggctgtggccgcgtgtggtggctcacgcctgtaatcccagcactttgagaggctcaggtgggtggatcacttgtgatcaggagttcaagaccagcctggccaacatggtgaaaccccgtccctactaaaaaaatacaacaatttgccaggcgtggtggcgggcacctgtaatcccagctacttgggaggctgaggcaggagaatagttagaacttgggaggtggaggttgtagttagccaagatggtgccgctgcactccagccagggggacagagcaagactccatcccaaaaaaaaaaaaaacaaacaaacaaacaaaaaaagaggtcaaggctgcagtgaaccatgattgtgccaatgcactccagcctgggtgacaaagtgagaccctgcctcaaaacaataaaaatataaataaaaataaaacataatagcaaacgtttcatagaggtggtatgagcattaaatgaactgataaacgtccctggaaaacagtaagtgctatggaaggattcgctgccgccaccgccaccaccattagcatgtttcaacctccatcaccctcactgtcccctgtcaccatcctttgaccagggcactcccagctgcagcctttctatcctcttgtccacccttcataactgtaagatcactcagctcccaagaaccacagtctacagggtaaccacatttccaaatctcaaaccagacccgctggtctgcacttccagggacaacaggatattttcaaaccagcccaaaagagatgtgtggctcagcataagaggaacaggagaaactgaggcctcttgccctgagaatgagcttggaagtggatgtcccggcctcactcaaaccttcagatgactgaggcccagccaggagcttgagtgtaccctcaggtcataccctgagccagaagcacccagctaatccactcctcatcactgactccctccccataaaaaacctgtttgctgtttcaggctgttaagttgtgggctgttttgttacacagcaatggataactaacacacgaggcctggcaagtgtggagcaaagctgcccaagccctcaagtctgttcatgtgggtgttggcctgtgtttgcagaaatccagccactgagtcctcccatgcagtcactactgccctctgcacagacacctgccacatccctgcctgggccaggagctccactagtgcaggaatggggtctgccgtcccaggaggatccctgacacctagcacagggctagcagcaggcagcacttggttagtgaataaactgcccttcacctgtacacagaagggatgtttctataaggggtaattaagtacagagctgggaagctatgctgaccagaaggctctaaaagcaattaaccaacgaggggaaaacccttcctactcattctcggcccattttattgagcactgaccatgtggaaggccccctggtgagactggggaatgcaccaataactgagacagcttccggctgttgccctcaggatgcctgagctgggatagggccagggtgggggtggtgcgtgtgacagggttactgttcacaaccctgccgggccataagccctccccaacaattccaaaatccaaaacgctctgaagatggaaagcttttgttgctcatctggtgacaaaacctcatttggtgcatgggccgggtgcggtggctcacgcctgtaatcccagcactctgggagccgaggggaaggatcccttgagcttaggagtttgagaccagcctgagcaacatgtgagaccccgtctctaccaaaaatacaaaaattagccaggtgtggtggcgcactcctgtagtcccagctactcgggaggctgaggcgggaggatcgcttgagcctgggaggtgggggctgcagtgagctgagattatgacattgcactccagcctgggtgaaagagtgagactctgtctcaaaaaaacaaagttaaaaaaaaaaaaactgtgcatgggtgtgggctacagatagtcttttctgccctacttagaatgaacgtgccacatttgctatagaaatattcaagggctggtggcaaatgccacacagaccctgacgctgttccaagttctgagaagtcctgcattcctcagggccccagagtttcagagaagagtctgtaggcctgagttaagaaggaacgccttcaaaagccctggggacaaaggggaaaggggtgccccaggactgcgtgggtacctaccggaacgagccgtccaggttggcacggtggatgaagctgagcttggcgtcagcccagtagagcttctgctcctccaggtcgatggtcagtccattgggccagtaaatgtccgagtccacaatgatcttccgggtgctgccatccatccctgcccgctcaatccggggcgtctcaccccagtctgtccagtacatgtacctgtgacgggggcagggcaagagaagcagctaacacagatctgttttttgtttttgtctgcatagatgcagacatgaaacaacagacagtgaacttgccctaaaatctcacccatcggaaataaccaacaggtatggtttcaggtattcctgccttaagctgggcaatcaaaatatactatttccaacttgttctcagttaacagtaaattctgggcaccttcccttcttgtggatagaaagattccttgttcttttgatgattgcctagtgtactctgctgtaagttttttaaagaacttcaggttatttctgatttttttgctaccatgaaaatgctgtaaatgaacctctaaaaggcaattcaaaacactcaggatggaatattatttagtggtataaagaaatgagctatcggctgggcccagtggctcacacctctaatcccagcactttgggaggccaaggcgggtggatcacgaggtcgggagatcaagaccatcctggctaacacagtgaaaccccgtccctactaaaaatacaaaacattagccaggcgtggtagtgagcacctgtagtcccagctacttaggaggctgaggcaggagaatcatttgaacccgggagggggaggttgcagtgagcagaaatcgcaccattgcactccatcctgggcgacagagcgagactccatctcaaaaaaaaaaaaaagaaaagaaaagaaatgatctatcaagccatgaaaagacatggaggaaacttaaatgcatgttagtaggtgaaagagccaatctgtatgagtccagttctaaacactctggaaaaagcaaatacacagagacagtaaagcatcagtggttgccaggagttggagaggagagggatgaatgagtggagcacagaaaatcagggcagtggaactatcctgtatgacatggaatggtgggtgcatgtccttactcatctgtctaaaccaagaatgtacaaatcaagggcgaaccctcgtgtaaacgtggattttgggtgatggtgcgtcagccagctttcatcagttgtaacaaatgtaccaccctgcacaggatgctgacagttgggaaggctgtgtgggtgtgaggacagggatgtataggaactcagtacctgctgctcatcaattttgctgtgaacctacaactgtttgaaaaaattaagtctatttaaaaacaacaaaacatggccaggcacgatggcttgcacctgtaattccagtacttcgggaggctgaggtgggtgggtcacttgagccaccctgggcaacatggcaaaatcccacctctacaaaaaataaaaattaaaaaaaagttagctgggcatggtggcacactcttgtagtcccagctacttgggaggctgacgtgggaggatcccttcagccctgggaggtcgaggctgcagtgagctgtgactgtaccactgcactccagcctggatgacagagtgagaccctgcctaaaaaaaaaaaaaaaaaggctgggtgcggtggctcatgcctgtaattccagcgctttgggaggccgagatgggcggatcacgaggtcaggagatcgagaccatcctggctaacacggtgaaaccccgtctctactaaaagtacaaaaaaaaaaattagccgggcatggtggcggacacctgtagtcacagctactcgggaggctgaggcaggagaatggcgtgaacccgggaggcggagcttgcagtgagccaagatcacaccactgcactctcagcctgggagacagcaacactccgtctcaaaaaaaaaagaataaaacccatggctgggatggaccctgaacctgcagctgcagctgttcctgggtaggtctgtgggcgacgtggctttgcttctccatgttcccaagagacaagcatcacccatccatgagaaacaagcacatcctcagggcgcccttacgtgatctctggccaatgaaccaagacaaagtgagcagacaccaggtctgggatggcaggtcccacccccaccagtgcccagtgtgccctgtttggaggtgaccacagggtgtgtgcccagaggctgggcgtgactctcagcggagaccagaggggaaccacaccagcttggaggactcagttcccatcccagccagctgggatgagccacaggacacaagggctggcagacctattgtgttttgtccacccttcacagcagagaaaggggacagtgcccagaatgtcctctgaggagcctcctcccactcttggtccttgtaaaatggtgctgactcccttgctcccttcttcctggggtgggcggcaaaccccattcccctcagccttagcaagtgatttagaaacaggcagctcgcccaagccaggcatgagagtgatcccgggacacagggagaacaagccccgctttgccctctgggggtctccattcagcagaagaggcaaatgacagacacacagccgcctcctcccccaccatggtgctctgcagcctcaggagcctcaggtgcaccaagggccaccccatccagggggccatgcttccttgagtggtatcgttcctgagcgagtaccatctccaccttccagaggggctgtgacaagatcaacaagaatgagggcataggagcctcgaaccaaacatgccctcttccctgcagaggctgactgcgcccagctgctatcaccaagcccctgctcctccggccccgtggggacagggtaagaggggtgtcacatggaacagctctccaaacagtccctctcaagctgctgtctcctgtgcatctagtgagaacccaaccaacaaagggaaggtgggaattgctattcccattaggcagatgagaaaactgaggccccgaaaggctggcctgttccaggttacaggcgctgagcggctgctctgggaacacacttggtgtctgctgagggcccgagcccggccatcatatgactcacccttcgccagcaaagcccgggtgtgggtgaacttttcctggcagcctgggactccaaggtgctggcagccagcccagggaaggctcccgcgtgcctgcggcagacgccttgctttacctgcacgtccccacccctaggagcctggacagagcccagaccctccgccacctcctgagaaggtatcaggggcatcagtctggacttgggggggaatccacacaggccttccccaaatgctccaccgtggcccatggaaaaggctggaaaacgtgcaggagcaggagcctccgcatggagcataattcacattccttccccgagtttcataacagaggcctgctggtttccttaaatggggaatttgcgagccagtcggtgaccagagactggttggcgtggacgtgctcttgcagagtctcaaacgctaccacaagcccagccaaattccacggaggaaaatcgacttccgaagaaaagagctgcagcatggccttcgtgcagagccagctgcggttgtggttgtgtgttattttagggaagggccattttgcattttaaagagggggttgggtttcaccctggctttaatttgagacccgggggccactgcagccccttgtcaggctggtacaggccggggactcctcccatgctaagccagtgtctttctggccccagatcctcaggggccagagggtcatccccagagcccgctctgccacccacatgggtaccctgggcctgggagggatgtgccttccctcaaccctgcctggatgtccgcacggggccacctgcattgctgaaactgcaacgaagtcgagtctcaggaggggcccccctggctgcagggctcttgatccttttggccacgtgcacactgaggtggacgctcggacccagagacccccttcatgatgatggccggggcaggaaccccctcctctgaggaaggaccctggtgggggacagcactgcaggagggcacaggagatgacgggggctctagcagggccgggaggaaggccaagatgctcctcgcaaccgtgtgcctgtggccaggacagaggacaaacccaccctccactgtccccactctcaggacagcagtcctgccccaggactcagcgcccacacttatgcctgaggaccactattcaagtcagtatttggcgagcaggggttgctgccgcgggcgctgtgacaggctggaatcctctccctctccctctccctctccggagacatggagcctacagggacagagtcagcacctcagggtaggaccatggctggcgtcatcagcatcactggatctgatgagtgggagccggcatctcactgttttcactctctcattcaaatgactggagcaaagggaaggtgtggggagaggcccaggaatcaacactaaggtcaactttgcccccaggggcaggggtgggagtgaacagccacaggtgtgatcctggggagggcttctgggagagaattcagaggcaagcatgtagaggaaccatttcaaatagttaagaaaagccagagccaaacagggacagttggctcgcagagatgatgcaggcaaagccagctcagatctgagcatgggaaagactactcccaaccaagggcccagcatctcccaaccaagcaccaagtacctcccaaccaaatgccaagcacctcccaatcaaatacctcccaaccaagcacctagcacctctcaactggacaccaactactcccaaccaggcaccaagtacctcccaaccaagtgccaagcacctcccaaccaagtaccaattacctcccaaccaagcgcctagcacctcccaactgagcatcatgcacctcccaacagagcatctagcacctcccaactgatcacctcccaacctagcaccgagcacctcccaaccaagtgcagagcacctcccaaccaagtgccaagcacctcccaatcaaatacctcccaaccaagcacctagcacctctcaactggacaccaacaactcccaaccaagcgccaagcacctcctaacaaagtaccaatcaccttccaaccgagcacctagcacctcccaactgagcatcatgcacctcccaacaaatcacctagcacctcccgactgatcacctcccaacctagcactgagcacttcccaaccaacatagcaaaagccataaagaagtaaaaagacaaaaccacgtaggcatggagactggacttctggtggcgaggaaagggcatttttattataacgacagctaacatttgttgaactcacaaactgttcttggtgttttcctcatgacatgcagcatggtcacgcctctgtacagacaaggatactgaggcacagagtggcaccgtgccaaccttgtctcatctttttatcgaacctacatgcagagtgccagcaaatccagctgtcttttctcttcagaacagatcccaaatctcgccactccttacccccacaagtgaggtgtccccgctgctgctttctgtcgccaggatcccggtaataaccgtggagagggctcctgcccccacgccacccaccccacagctcactctcgctccagccaccaggggatgccttccagcacgagtcagagctggcacctcctctgctcgagacctcatgtgtcctctcctcacaccttgggccctgtttccctacattctgctacagcccctcaaacaggccccgccccaaaccagcccagggcctttgcactggctgatccctctgcctggaccgcgctgcccccagacagccacacggttctcagcctcatctgcttccagtctcgactcaaaagtcaccaagaggccttcccagcacctgagctccgacggaagcccctcgccacagcacccaagcactgctttatccccctacgcacacgtccctttcaaatactattcatttaccatctcctcccactcactgaaagggccagagactgggctatacccgctgcgtggggagcaggaccaggcgcaagggctcacaaatgcagtggatgcctggttgggaggtgagggagctgcagcgacccacgctgggagggaacgcaatgacaggaggagcgcaggtcctggcgacacgatggccatggcagccgctggtgagcaaccgcaggccggccctgggagagggcttctagcaagctgctatcttcagcctctccgactactgcagatgccccctcctagccagagacactgctacaccagccgacccttccaaaaagaaggtcagtaaccccgcgactcctggagccacagtgcagggggagagggctgagagggcaacagttcaccaagcggaacagaggctgccccggaggtcagctggctccccggcagctgcaggggtggctagcccactcggagggcagcgagggcatacgaggggctccagggatgagtggttgcccagcacagcacccctgggaggccgggggcacttctcaggtagtgggggcacgaggctgctctggcctgacctcagggactcaaaatactttggcgataaattccaccgtgtcccacccctgctggtaccccatacttacacacagactggttcagatgcagacactctcgcgcacatactcgctcacacgggcacatacacgtgcacacacagtcacatgcgcacactcatacacacacaaatatccactcacacgcatgcatgcacacacacggacacacacaggctcacacgtatgcacgcatatgcgtgcacacgcacacacacacacacacgctcacatcctcccactcccacactcagttgctcagacacacacacgcctggctctcacacaaacctgttgggctctgaaaggctccagcccttcccatgctcgtcagaagccagtcaatggcttcctaagtcaccacacagatcaaagaggtgaacttggccacatggcactctgcttcctgagctcccaaacaccagccttggtgaggacagaccctcaccccacaccctcattcccactaccctgggcaggcccagaggaggggcatctgcaggatctggcaaccagcccctcccgcccggctcctgcagccggcaccatgggagtcagggggaggtcactgcaaagggcaacagcaagttggtggccccaggactagagcccaggggtcttcagtcctactccagagcttggacactgtcccacagggcatggccaagggaagggcttccagagccctgacttcagggaggagggcaggcgggctcctgtggcaggcctggatgcatggccgcccactcctgggactttctaacctagaatatctaggtcaggctgggtgcagtggctcacgcctgcaatcccaacactttgggaggccgaggagggtggatcacttgaggttaggagtttgagaccagcctggccaacatggcgaaaccctgtgtctactaaaaatacaaaacctagccaggtgtggtagtgcacgcctgtaatcacagctactcaggaggctgaggcaggagaatcacttgaactcgggaggtggaggttgcagtgagctgagatcgtgccattgcgcaaagaagatctaggccggcccctcaaccggtgaggtccaggctgggagtgctgagagactgtggtgacactgaatgaactaacaggcaaagggcttccaactgagcctgggggtggtgggaaatggctcttgtgttctagtcaagacctctgccaaccagttctgacactgacccagcacagaacctgacaggtcagcaagggccagggcttagcacagcccaggtaagggtgtgtgtacggcccccagagtcactcccaggctgcaagaaaagggacaaaggagggacaaggggtggccaagcaaactgttccctctgctcgggagtctggggtgacctggcctagctggccagtggagctgggccacctccccttaaactctccaccccggacttcgactccaaagctttcctgccacccacgctctccccacctgggatcacggccaggccctgagccttcaagggcccaggtgaactcagccagactaggagctgaggaggacacagggcagcttccagaacggacccgagaaccactcccagcaggttctgcttccagacaaggagctgcactttttcagccaatgcaattagaaagccaggagaaggtgcaaattccacctgcctgagcgtccgcacttcccaggccgcccaccatacacacagcaaagatgtgtttaaccattcaaacccatggccaaccacatcggttgcctcagacatgcaagttttaaaaaggaacataactatgggccaggcacggtggttcacgtctgtaatcccagcactttgggaggccgaggtgggtggatcacctgaggtcaggagttcgagaccagcctagacaccatggtgaaaccccatctgtaccaaaactacaaaaattagctgggcgtggtggtgggcgcctgtaatcccagctacttgggaagctgaggcaggagaatcacttgaacccgggaggcgaaggttgcagtgagccgagattgtgccactgcactccagcctgggcaacaagggagactccatctcaattaaaaaaaaaaaaaaaaaaaaggaacataactatggagtctcaaggggaagtaattccttcaacaataacaaatcttgaaagctgagctcttttttttttttgagacaggatctcctcactttgtcgcccaggctggagtgcagtggtgggatcacagctcactgcagcctcgatctcccaggctcaaatgatcctcctacctcagcctcccaagaagctgggattacaggtgcataccatcacacccgattcatttttgtatactttgaagagatggggtctcaccatgttgcccagtgtggtcttgaattcctggactcaggtgatctgcccgccttggcctcccagagtgctgggattacaggcctgagccaacacccccacgggttcattttcagagtcgcaccgagtgctggggttacaggcctgagccaacccccccacgggttcattttaagagtgacaccgagtgctggggttacaggcctgaaccaacccccccacgagttcattttcagagtcgcaccgagtgctggggttacaggcctgagccaacccccccacgggttcattttaagagtgacaccgagtgctggggttacaggcctgagccaacacccccacgggttcattttcagagtcacaccgagtgctggggttacaggcctgagccaacccccccacgggttcattttcagagtcacaccctttttctgaaaaacaacttgggctcatgcaaattcgagagagagatggtgacactccccgccccctggacccaggtggagtcgcagcagggtttacccgtgagcggggtccaaggcgatggccctcggctggtcaaggtcctgccagaagagcaccttccgggatgtgccattgaggttggccacctcgatgcggttggtctctgagtccgtccagtacagcttcttgcccacccagtcgcaggcgaggccgtcgggagagaccaggccggagatgaccacgttctgcacggcggcccccgtctggttcaggtaggtctgcttgatggcctcctcgctcacgtctgtccagtacacggctcccttggaaaactggaagtccactgcggccgcatcctccaggccgctgaccacgatggtggactccagcttgactccgccggcgtccaccagccgtacgtcccggcggttggcaaatagcaggagcggcgaggctgtggggcagaagcaaaccgtgagggccactggctaagccagcaagatacacagccctgggatggagcactatgcccagagcactcctggtactgccctgcccatgcccaagacctccagttccttcctcccacccctaaggcgttgtcaggaagttgcctgggcagccccggcccgcatcattcagaggctcctgcagcgcagcaaacagccttcttcccacattcggtgacagcacctgtttgtttaccaactgttacgtctgttcccccagatatgggtgacccttcctgccatgcccaaaacctcccacatcgtcctccagaggctacaggggccctgtcctgttctgcagagaagccacatcccctttgttggcctgacacaggggatggggacatgcaggcacagcactggccatgctgctcgctacagacccagccacagggccacattttttgaggggttcagagcccaggccagacagagcctcaagattcccttacaagtctttgaccactgtccaagctcaggcccgtttccttggccgtggcatcagcttcccatccacccctgtattccatgtttctcccaccctgcttctggacattcctacatttaaagggtcactctggaatgccaccccttggctcagacaccttccacagctccctgtgccagtgccatgcagaacaaggtcagaccccctagcctggcctccaaggccttggcctctggcctcacctacacttctctccaccaccccaccccaagcattcctgatctgcctgcggccaggctggctccctcacctccctgtgcaccgcagccctcagccccttctgcctgtgcaagaagcctcatctcacagacaacggtctcattcccacaacgggctcaatgagaaatcaggagaggccttcagaccatcaccccaccagacacctcagacgtcggaccaggagggtccagcaacccccaacacagactcagagggactaagaagccacatgaggagtgaacacaagatgtggacaggaggaggttaagggcctccagggagctccatcagtccgtgttctgctgtcagcagggttaggctgggctggccacaaacacccccaaaaaacatctgaagccttggcttgaaacagctgacattcctcatgaaaactgcagacccctgggtcctcctgcgcagatgggggagcccagccaaccccacactcccaccttcaccaagaaagagaaagccaaaacaaactcaactcagccaatgacaatcacagaactgaatcctgtagttagttcagttggtttcatttcagcaggggaaagatttgcagcctctatgagggtagctgggaacacaaagggccagagcatggcccaggagaccccagcgcagtggggtagatggttccgagcacaggcctccctgccaagacaagcactggctcaaatcctggcccctcccattcccaggagacatgctccacaggatgggaggacacacagaggacctgaggccaggaaaatgacagcggcgcctccgccgccccacccgtgctgtcatcatcttaggtctacagttctttgtggcaacgagggacactgtgaaagtcaaacaacaggaaggcataggccacaaataaagacaaacgggacttcatgggaagctaaagattttgtgcatcaaaagacactatcgagagagtaaaaaggcaacccacagaatgagagaaaatatttccaaatcatagatctactaagagattaatatccatgaaatacagagaactcctaaaactcaacaatgagaaaacaactaagccaactcaaaaatgggcaaacaacttgaacagacatttctccaaagatgacatataaatggccaataaacacatcaaaacaggcttaatatatccctaatcatcagggaaatgcaaatcaaaactacaataagataccatcttgcaccaattaggacggctactatcaaaaaaacaaaatagcaagtgttggtgaggatctggagcaactggaacccttgtgcaccactggcaaaaatgtgaaatggtgcagctactatggaaaacagcatggcagttccccaaaaacttaaacacagaattaccatatgacccagcaatttcgctttgggttatatacccaaaagaactgaaaacagggacacaatcagatatgcatacaccttggatcacagcagcatccttcccaacagctaaaacatggaggcagccaggcatggtggctcacgcctgtaatcccagcactttgggaggctgaggcgggtggatcacctgaggtcaggagttcgagaccagcctggccaacatggtgaaaccccgtctctactaaaatacaaaaattagctgggcgtagtgacgggcacctgtaatcccagctactcacaagtctgaggcaggagaatcacttgaaccctggaagtggacgttgcagtgagccaagattgcgccactgcattccagcctgggtgacacagcgagactctgtctcaaaaaacagcaaaacaaaaacaaaaaaacaaacaaacatggaagcaacccaagcgtccctctactgagggatgaatagcggggcaaaatctgctccatccacacaatggagtactattcagtctcaaaaaggaaaaagattctggtcaggcacggtggctcatgcctgtaatcccagcacttggggaggctgaggcgggtggatcacctgaagtcaggaattcaaggcccgcctggccaagactggcaccnagctacacanaaagtatanggccccggaaa

SEQ ID NO: 9 - DNA, 72049 bp, Homo sapiens
  unsure (8356),(8385),(38585): Identity of nucleotide sequences at the above locations are unknown.
tataccttgcgcggaccttcggctcctgtggtgaagacaatatgaagaaaatagaaattacccataattttgccacacagacttagttgtgtccatgtatcttgtgcaccttttttctgtttacggatcaaaatcgacttttagggtcaggcgcggtggctcacacctgtaatcccaacactttgggaggctggagttggggttggggggtggatcactgaagatcaggagtttgagaccagcctggccaacatggcgaaactccatctctactaaaaataaaagattagccaggcgtggtggtgggtgcctctaatcccagctactccggaggctgaggcaggagaatcgcttgaacccaggagacagaggttgcagtgagccaggatcacgccactgcactccagcctggcaacagagcgagactctgtctcaaaaaaaaaaataaaaataaaataaataaatacataaattgacttttaggagattggttcaaacaatgtgtgtaatgttgtgtctgagtgtttttcatttatcgttcatgcaaattccgacatcattcactcttctccagagtgtgctgttttcctgcctgtgtcatcacccgtcaccttgaatgccctcgtttaggtaaaataagtacattttattcaaaaatatttgaggacatttgggttgtctccaggttcttggtcttgagttttgctgttcttgtggagccatggtggtgtctggttgcaggaacctccatgcgttccagctgctgcttctgcctgtgttcttagagaggaaatgctggggtccgcggttcccgggctgctgaccaggaagcctgcggtgctttacggcccttccagaagcgggagatgcccccacttaagtgtcagacaggcctttccacctcactggcagctctgagcggctcccttctatttgcagatgactgagaagttaccaatttccacgtttactgactgctgtttctcctgttaatttgtatttatagtcttcgctaatttattgctagggttttggtgttgtccctattgacttgtatgccttttaattttttaaacaacattaatatacttcatttttttagagcagttttaagtttacaggaaaattaagggacaagtacagagagttccttccacctgctgtcctcctctcctcctccccaccttccctccttcccctattgtaactttctttctgatattataaaagtcactcatggctgggcgtggtggctcacgcctgtaatcccagcacgttgggaggcagaggcaggcagatcacctgaggtcaggagttccagaccagcctggccaacatggtgaaaccccgtctctactaaaaacacaaaaagttagccaggcgtggtggcgggcacctgtaatcccagctactcaggaggctgaggcaggagaatggcgtgaacctgggaggcagaggttacagtgagtcgagatcgcgccactgcactccagcctgggcaataagagtgaagcttcgtctcaaaaacaaagtcacacacgcttcttgtacgagggtcatttggccgaggggccagatggctcaccatctagttgggacaggccatgagctcggaatgctttttacatatttacatggttgagaagaaaatcaggagaataatgttttgggacatgggaaaatgacatggaatttgcattttagtgtccataaatgaagttttgtttgctcccagctgtgttgactgaggcaggctggcttcctacagctgcggcagagctgaggaggcgggaaggagaccgtgcaggccgcagcaccgaaaatatttgctctctggcccttcccagagtgcttgccgacctctgtccgacagctagaaggaaggataggacccgtccgacgataaccactgttgacatttgagcgcgtttccttcccggcttttgtgtgagagtggcagtctgtttgcttttgtggtcgggatctgctgcacgcacggcgggctgtttgcatgaggcttcctggaggatagggctgggctcggagctgcacgcagtggggcgtgtcctgcatgcagtggggcctcagaagagagctgtggtgggcggggcagtgccaacgctggtgggtgccaggcctccacgctcagatcagccccggcgacaggtttgggccaccctctctctggcctctgtgcagtggcccaggccgtctgctctgcctggcacacttgcctctgtccttccactgaagcgctcctcttaccctctgctcccggctgggtacgttgaattgtgtccctcaaggagatatgctaaaggtctaaccccaggaacctgtgtatgtgatctaatttggaaacagggtcttggctgatgtaatcaagcgaggatgaggtcaccctagagtagggggcctatatccacggtgctggtgtcctcatgagagcaggtgagcagacactgacactcaggggtgaaggctgcatggagtcagaacagggcttagtgcgatggcggccacaagccaaggaactccaagtatttcctgcaacaccagaagctggaagatgccaggaaggatcctgccctggagccttcggagggagtctgtccctgcagacgtcttgacttttgattgcagggatgcatgtcttagggtgtgtgggggggtgcatttctgatgttagaagccacctggttggtggcgatgtgtcacgggagccctctgcaggttctgcgtgtccatgtggtcggggacagaggtgggcagggacggacggtgtcgagctggacatgtccatgacgtcggccatcccttgggatggcttttttgttttgaggataaggctgcctgccaggaagctgtgccctgcctggcccttgccccaagcccctggcctgtgcttggcctcgcggaagggatgtcgcccttctctcctgcatgcgtgcagggaggaaggggagaggtcagcagcccgcctggaggaggctcgggcgaggggaaggtttcactttcaggcaatgttgtggggctgtttaaacaaccccaaagaaaaccatttggccaaactgttagtttccaaacattttacttccttggtgtttaaataaattcctaccaagactctgtagctggtcccagggaaggagttggcctctcttctttatagcccggcacagtcagtcccctgcacctgcccctcccaaccccaggcctgcttccccgtggccatggctgctgcccggacctctctacacacagaacctcctggaggccagctgtgggcaccagccttggcagggctgtggcggagcccaggctgctggtactctctctgcagctgctccctgctggcctggctggacagcgtccccaccaccactggggtcacctctgtgctggtcacagctcactcagaccttcaggcaaatgggttggatcctgcctctctcccaggtgtctcagtctctgcaaaactcaaaaacctcagaggccttgcagcctgaggggtgtcagagacacctccttcgaatcagtaaacacctacagattcaccccagcagtgaaaggactgcttcgccacagaggtttgatttactcctaagtaattggaagggatgccgagaataggttcctcatggtgggactagaggccctctgctgacctagttaacagagggctagggctgggtgtgctcagcccctgaaggttctaggcccatttgggacaccccgccagaacctgccacaacctgccatgtggtgacagctacctaaatcccagaggctcttgagctggagagcagacctctcaatctcagcaggccccccacacagaccccataaccctagtctgccttcacagtacagttcgtggctatgtgttcacggatggtgttgttcacctaaggtctctgccctgtgaccccaagggcgtcctgagggcagattccaagtctgtttcgtccacccctccttccctagcagcgggtccagggcctggcctgaactagcttcccacagagatactggtgggatgatgaaggcagccaggcggcaagtgaaaaacgcacttcctgcatgtgctggctcctgggattgaagtgtttgaggaagcaaagtgaagtgagctttcctcttgcggctgtgtgtccttgggccgggagcctaccctctctgagcgttggggtccttgtcagtagaatggggcatcctcatagctcaaggggtggtgtgtgaaaattgtgctattgtgttactttaatgattttttttttttcgagacaaagtctcaccccaacgcgcaggctggagtgcagtggcgcgatctcagctcattgcaacctctgcctcctgggttcaagtgattctcctgcctcagcctcccaagtagctggaattacaggagtgcgccaccaggcccggcatatttttctatttttagtagagagggggttttaccatgttggctaggctggtcttgaactcctgacctcaggtgatccacctgcctcggcctcccaaagtgctgggattacaagcatgagccaccgcgcccggcctactttagtgatttcttaggaggacagagggaacgggctggcaagacaggcttggaatgtgttttgggatcaagtgccggtttctgtctggcactggcgttctctgtggggccatgatggacacactgctgaggtcaagcgtgattcgtcttgcgctgtgcctggcagtctcattggaaagttctgtagacatcgtgtggatggggctcttcccggccaagcccttggggaccttccaggactgtgatctccccacagtggctgttaagcagggacctttcgtgaagtggagtctctggtcccctccaagtcatagctagacagggactcgggcatcgccaagcctggctgattattcactggatgaggagacaggcccagagaggggcaggaacctgcccgaggtcacccagcaggccccagaggtttcggtctcggattctccctgctcatccctggatgtagtgctgctgtggatgtggttctgtgctgggggctgtggagagcagggggcttgtgccaggaccccagtgagggtggcgccctcgccatgaggccgactgttggtatggggcggccatccactggggtgtggggaggaacagctttcctgaggaggaggtggcgggaggaacagcttccctgaggaggaggtggcggtgctgtgtgacctgggccttgaaggacaggtccattgtcaacagaacattttgggagtggagcctagagggagaaaatttgttgaaattcagattcccctccccctaccaatacacaccaaatcagatgcccctgaccagatctaaatttggctctcagagatttccattgtagctgggcacttggggaaccttctaagtgctgcctctgcctctccccagcctgcctgcctcagtttccccagccctgggcccgtgtcgctgttgccatcacgtgggcgccctctagtggaggaatcagattatgcactccggggcttggagcaggagtcaggaggggctcctgtctttccttgaaacgttggatgccgggatcctggaacagtctctgcattcctcctggcgagaaccagagcctgggcacaggggaccatctgttgtttgaaggctgcagcctggcagggcactcaggagatctggcagttggctgcagggccaggtctaggggccagggcatcagggaggctctgggctggttcagccccgggcccctttgcagattgtgacctgggcccctgtgcaggggcatggccacaggatgctgggaggggtctctgaccctgaccttcttggctctgtgcatccttgagaccagaaaggtctggaacaaatgagtagacgatgccctaacctggggagggagccacatcctgatcccagcaacctcgggaaggatctgtcaggattatggggcaccctgggggccccaagtctgcatgggtctccacttgcaatttctgtaggaagctctgataaatccaaactgggggtcctaggacacagtcagaaatgctgataccgttgtgtgtggagcctcgggccctgggggtcaggagcatgtggagggtgggccacgggggttcagaagagaatcctgtaaccccccaccccccaaactgaagcccacttgagggccatggctgaaaggttggggggtctccgtgcgtcctgtggagtgggtggtgaggagtccttgggtttgcacgcctctgggcctgagcggcgggaccccgtccacagcggatccctgggccctgttgctcagatgctctcagagtgttgctgtggccacggagggagcctgagttaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctgnaaactggagggagccctttgtccccctgncttcagtttcctcatctgtagaatggaacggtccatctgggtgatttccaggatgacagtagtgacagtaagggcagcctctgtgacactgaccacagtacaggccaggcctctttttttctttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttaccaacactgacatttaccgacattgacatttactgacactgacatctactgacactggcatctactgacactgacgtttaccgacactagcatctactgacactgacatttaccaacaccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcctgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagccctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtttcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggttggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggaccgccatctcacatgagggtcttgggcctgcaggctcgttcaggaaacacccgctgagtatgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagtcctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctcctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttgggccgcacccctttccctgctgggctgttgatgtttagactggagcctctgtgttcgcttccaggaaccaacccgtgtgcggacaggaacggggggtgcagccacctgtgcttctgcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggggaacagacggggttggcctcccaaagggcggaaataacaggggtgagccaccgttcccggcctaggaaaactttttgccttctaaagaagagtttagcaaactagtctgtgggctggccttctgattctgtaaagaaagtttgattggtggctgggtgcggtggctcacacctgtaatcccagcactttgggaggccgaggtgggcagatcacctgaggtcgggagttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatttcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaaaaatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaataatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaatacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccacgctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcatgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggctttnttttttttttttttttttttttttttttgaaatggagtctcactctgtcaccagcctggagtgcagtggcatgatcttggctcactgcaacctttgcctcctatgttcaagtgattttcctgcctcagcctcctgagtaactgggattacagggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcgtagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatttatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcaatgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttctgccgaatgccagcctctcacaggctggggagactttccaccctggggatccaatgggtggctttccagggtcccaaaagcaaacacaggctctttcacagcccctccaggaaagcagaaagccccaagggctggaagggaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactcttttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccccaggtccttgccccgtggccctctctgcctcagcagtgggggctccctgcgtcagtccctcccgcaccttgagtctctctgatttgcttctaaagggccctgtgattcggctcagccacctttagattaggttagcctcccctttgatagactccaagtcggctgattaataaccttactcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtaaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccattgcactccagcctgggtgacagagtgagactccgtctcaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaactgtttccggcatccatttgtgtgtcaatttccgtgtcagtaggaagactctgtaggctgccaagaggaataagtgggaggatcctcccagagaggccgggcctgcaggagggccagttctcatgagttcttatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttggtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcacccttttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggatcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtctgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcttaggaaatggggggccacctcgaaacctaggcctcctctggcttctctgtgccagtgcccccacgctttgtgtctgtgtccccagcccatgggactgtgttattccctgagtgctgccgcatgcccagcccgcactgaggacgtggagccccgaggggcaggatggcctccatggtcacacgtaggaagtggcctccaccctccgatgatcctctccccccctccctttcagcgccttccccgggggtgtcatcagccctcctgcctgtgctttgtcccgtcttctgcaggcgcatgggacgtgctgacaggtcctctgccgggttcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcatgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaggagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtggaagtcgaagcgggagcaggtgcatcacatggtgagagagggagcaacggagagagagagagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgcctcagcctcccgagtagctgggattacaggcacacaccaccacacccgggtaatttttgtattttcaatagagatggggtttcaccatgttggccaggctggtctcaaactcctggcctcaagtgatccacttacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcacgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacccgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttatttttcttttttttttgagacggagtttcacttttgttgcccaggcttcagtgcaatggtgtgatctctaggctcaccgcaacctctgcctcccaggttcaagcagttctcctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggactccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaatgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggtgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcacaaaaaaaaaaaaaaaagaaaagaaaagaaattatcaatctcctcttttatggcatatatatatatatatatatatatatatatttatttccctttcttggttatgttcataaaggcctcccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagcttctcgggagtctgaggctggagaatcacttgaacctgggaggcagaggttgtagtgagccgagatcatgccattgtactccagcctgggcaacaagagcgagactcagtcaaaacaacaacaacgcaggaatagcagatgagccgaggtggggcctccccagcccccaccccccaccccgcaccctgggccgagatccagtcctctttgaatagggcctgggcgtggttcacgggacatctgagacattgccgaggcgctgcactggtggatcttgccagaagtctgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagacgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcaccctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctagtgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccaaactctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattcttttgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtcttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgagtattctatagtgtcacctaaata

SEQ ID NO: 10 - DNA, 8705 bp, Homo sapiens
ggactcaggggcagcagggaggtacacccatggttagtgggcggaccatagggggtaatgagagggtgaatcgatggaacctgggggacacaatcgaagtggttccagagtcgggctgtactaattaaagagacggggcagtggacaggcattttcagttgactgcccagggagtgttctgcccaacagggaggatatgcgtacagaatcatactcgatcagcatgagtccaattcagaccgtacatcagtggagatatgggtcccccgatgactccgtggaacactgatgtttgtgacaggggagtacagcaccagccatcagcaggccagtaaatcataccggcctgcgaaattggactcagacccggatccaccctgaccgacgtcccaagcccccaccccccaccccccaccatgggccgagatccagtcctctttgaatagggcctggccgtggttcacgggacatctgagacattgccgaggcgctgcattggtggatcttgccagaagtttgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagatgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcaccctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctaatgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccagagtctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattctttcgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtctttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgttgctgggtgacagtgcatttaataatcaaaatataggctgggtacggtggctcatgcctgtaatcccagcactttgggaggctgaggcaggtggatcacttgaggccaggagtttgagaccggcctggccaacatggcaaaacctcaactactaaaatacaaaaactagccgggcgtggtggtgcacgcctgtaatcccagctacttgggaggctgaggcaggagaattgcttgaacctgggaggcggaggctgcagtgagccgagattgtgccactgcactccagcctgggcaacagagcaagactctgtctcaaaaaaaaaaaaaaaaaaagcaatacaaaatacaaatatcactttcactaaaagaagggatggaagacccaaaacaaacagaaaacaacaaaatggcaggagtaagtccccacttatcaataataacattgactgtaaataggctaagctctgcaatcaaaagagtgggccaggagcggtggctcacgcctgtaattccaacgctttgggaggctgaggcggatggatcatttgatgtcacgagttttaagaccagcctggccaacaaggtgaaaccccatctgtactaaaaatacaaaaattagccaggcggtagtggcacgcacctgtaatcccagctacttgtgaggctgaggcaggagaatcactggaggctgggaagcggaggttgctgtgagccaagatggagccactgcactcccacctgggcgacagagtgagatcctgtcttaagaaaaaaaagagtggatgaatggatcaaaaaacaagacccaaccatctcttgcatacaagaaacacactttacctataaaaacacactaggccaggtgtggtggctcacacctgtaatcccagccctttgggaggcctgactggcagatcacctgaggccaggagtttcagaccagcttgaccgacatggcaaaaccccatctctcctaaaaatacaaaaaaacaaaaaaaagaaaaaggctggaagtagtgatgtgtgcctgtagccccagctacttgggaggctgaggcaggagaattgcttgaatccgggaagtggaggttgcagtgagccaggatggtgccactgcactccagcctgggtgacagagcgagaccctgtcataaaaaaaaaaagaaaagaaaagaaaaacgagaaaaacaaacacaaaattagtagaagaaaagaaataataaagatcagaacaggccaggctcatgggcacagtggctcaactcctacctgctcaggagtttgagaccagtctggccaacatggcaaaaccccatctctcctaaaaatatgaaaaaaaaaaaataggctggatgtggtgatgtgtgtgtgcctgtagccccagctacttgggaggctgaggtgggagaatcacttgagcccaggaagtggaggctgcagcgagtcatgaatgcaccctgcactctagctgggtaactggagtgagattctgtctcaaaaaagcaaagaccagagcagaaataaatgaaatggaaatgaaggaaacaatgcaaaatgatacaaaaagttttttcgaaaagataaacaaaatcaacaaacctttagccagattaagaaaaaaagagagaagacccaaataaataaaatccgagattaaaaaggagacattaccactgataccacagaaattcaaaggatcattagaggcaactatgtgcaactatatgctaatgaactggaaaacctagaagaactgggtaaatttctagacacatacaacctatcaagattgaaccatgaagaaatccaaaacctgaacaggccgggcacggtggcttacgcctgtaatcccagcactttggaaggcctgagatcaggagttcgagaccagcctggccaacatggtgaaaccccatctctactgaaaaaatataaaaattagccgggcgtggtggcgggtgcctctaatgtcagccactcgggaggctgaggcaggaaaatcacttgaacctgggaggcataggttgcagcgagccgaggttgcaccactgcactccagccttggcgacagagccagactccatctcaaaaaaattaaaataacaaaaacctgaacagaccaataacaagtaatgcgatgaaaactgtaataaaatgtttcccaacaaagaaagcccaggaacaaatggcttcactgctgaattttaccaaacatttttttttttttgagacggagtctcgctctgtcgcccaggctggagtgcagtggtgtaacctcggttcgctggtaacttatgcctctcaggctgcaagtgattttcctgcttcaggccccccgagtggctggaaattagatggtacttgtcaaacaaggcctggctaaatttctatatttccttcaagtagaagatgtgcttccaacaaaggttgggttacggctggcttctgaaaatcttggatttcaaggctccccaaaag

SEQ ID NO: 11 - DNA, 66933 bp, Homo sapiens
tataatcaagcgcgttccgtccagtccggtgggaagattttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctggagacctggagggagccctttgttcccctggcttcagtttcctcatctgtagaatggaacggtccatctgggtgatttccaggatgacagtagtgacagtaagggcagcctctgtgacactgaccacagtacaggccaggcctctttttttctttttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagcctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtctcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggtgggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggacccccatctcacatgagggtcttgggcctgcaggctcgttcaggaaacacccgctgagtacgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagttctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcagcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcatctcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggtgatctgcccgcctcggcctcccaaagtgctgagataacaggtgtgagccaccgttcccggcataggaaaactttttgccttctaaagaagagtttagcaaactagtctgtgggctggccttctgattctgtaaagaaagtttgattggtggctgggtgcggtggctcacacctgtaatcccatcactttgggaggccgacgtgggcatatcacctgatgtcgggacttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatctcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaaaaatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccaggctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcgtgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggcttttttttttttttttttttttttttttttttgagatggagtctcactctgtcaccagcctggagtgcagtggcatgatcttggctcactgcaacctttgcctcctatgttcaagtgattttcctgcctcagcctcctgagtaactgggattacaggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatttatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcagtgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttatgccgaatgccagcctctcacaggctggggagactttccacctggggatccaatgggtggctttccagggtcccaaaagcaaacacaggtttttcacagcccgtccgggaaagcagaaagccccaaggggctggaaggggaaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccacaggtccttgccccgtggccctctctgcctcagcagtgggggctccctgcgtcagtccctcccacaccttgagtctctctgatttgcttctaaagggccctgtgattcggctcagccacctttagattaggttagcctcccctttgatagactccaagtcggctgattaataaccttaatcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtgaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccactgcactccagcctgggtgacagagtgagactccgtctcaaaaaaaaaaaaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttagtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctgggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtatgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcctaggaaatggggggccacctcgaagcctaggcctcctctggcttctctgtgccagtgcccccacgctttgtgtctgtgtccccagcccatgggactctgctattccctgagtgctgccgcatgcccagcccgcactgaggacgtggagccccgaggggcaggatggcctccatggtcacacgtaggaagtggcctccaccctccgatgatcctctccctcctccctttcagcgccctccccgggggtgtcctcagccctcctgcctgtgctttgtcccgtcttctgcaggcgcctgggacgtgctgacaggtcctctgccggctcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaagagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtgaaagtcgaagcgggagcaggtgcatcacatggtgagagagggagcaacggagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgtatcagcctcccgagtagctgggattacaggcacacaccaccacacccggctaatttttgtattttcaatagagatggggtttcaccatgttggccaggctggtctcaaactcctggcctcaagtgatccacctacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcatgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacctgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttctttttcttttttttttgagacggagtttcacttttgttgcccaggcttcagtgcaatggtgtgatctctaggctcaccgcaacctctgcctcccaggttcaagcagttcccctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggcatccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaacgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggcgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcaaaaaaaaaaaaaaaaaagaaaagaaaagaaattatcaatctcctcttttatggcatatatatatatatatatatatatatatatatatatatatattttttttttttggttatgttcagaaaggccttccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagctactcgggaggctgaggcaggagaatcacttgaacctgggaggcagaggttgcagtgagccgagatcatgccactgtactccagcctgggtggaagagcggaactctgtctgaaaaaaaaaaaaaaaacaagaagttcaacttgaagggaaaaatgccgtattgtctttccctttgttatgtcaccagggcacagtccatcccaggctggcgctgatccacgggctggagaggggctgccccagaagaggacatgccaggaagggcttggctggtgttcaggagcccaggccaggtcaggtcaagaggtgttgaggctggacgggagaggccagctaggggctcatgtaggatatgaggggtcggcccatttcaacgtggaaactgagctcttctgcttctctttcttcttcactgcattaagattcaataccgcttgggaagcaggtatttcccttcctataaaggatggttgggagcctgagtgttgggagaaagtgtagccgctgagttactaacaactagggctgccgtcaagcctatggggaaagagagaagaggacatttggaaggagagagatcaagctgtggcaccctgggagaggaccacagaaaagaggccagtgagggggttccccggtggcatctgaaggtgtggcccaaccaggaggtccagaggctgccagccgagtggcccaggagagggaacctcacaggggctgagtgggacccaagccctatccaccgtcctaaccacccacatttctcgggaacaagacctcccacagtggcctccccggcagtggaaatagccaaactggcaacatggactttcttcaactgcccgggcgatgctgcctcagtgccccagggcaggcaggaagctcccacacccattctggaatgaggggttggaggaaggctgagctgagcaaaggacccatctctgctctggttggtggggagggagcccattatacaagagacccctcagggctcagtgaggggtgacagagacttggggagtagtggctgtcactgcagaggtgagagggtttggagagaaggtacatgcctttttggccacattgagtagcacctggtagccagttagtaacgtgtattggataaacaaaagattaaacggatgcaaaaaaaaatgttggctttgcttctttttacccaaacctcagttccctcaagtagattctgggaacaccccctacctggctggactgttgtgaagtttaaataagccaggttaacttcacctcctcctttaagacacagctcagacactgcctcctccaagaagccccctctggcttcctgtgtgaatatgacggccctctgggctctagggtatcttagaacaatgcttccttatggctttggaaccccgctgtctcctggattgggagcaaatgcaggggaggagccacacctgactaatctctgggtctcccagcacataagtggcataagggcagggctgtgcccgcttcaggcacttactgaaggatgtacttggcagagggtaggcagccggcggatgagcccctcactctccccagctgactgcgtgggcgggaaaggcgggttcaggagacccagcctccctgggctgtcaccacctctgcacatccagccccattgatcaagggttcaatttttggggtcctgttgggaggccaggagactctctccaggcacttcttccaggtctttgtgttagggtgtgtgtgtgtgtgtgtgtgtgtgtgtgtgtgtgttgtttgttttattttatttatttatttatttatttatttatttatttatttattttgagacgcagtctcgctctgttgcccaggttggagggtggtggcatgatctcggctcactgcaagctccgcctcccgggttcacgccattctcctgcctcactcttcctgagtagccggattacaggcgcacgcaccatgcctggctaattattttgtttttttagtagagacagggtttcgccacgttgcccaggctggtcttgaatccctggcctcaagcgatccgcccgcctcagcctcccaaagtgctgggattacaggcgtgagccaccgtgcccgcccagcctaggggtacatgaaacttttttttttttttttttgagacagagtttcactctgtcctcaggctggagtgcagtggcgtgatctcggcgtactgcaatctccgcctcccggttcaagcgattctcctgcctcagcctcccgagtagctgggattgcaggcacgcgccaccacacccagctaatttttgtatttttagtagagacgggctttcaccatgtgggacaggatggtctcgatctcctgacctcgtgatccgcccgcctcagcctccgaaagtgctgggattacaggcctgagccaccgtgcccagccatgatgttttgatacaggcatataacgtataataatcacatcagggtaaatgatgtaaccatcacatcaagcatttatcctttgtgttacaaaaaaaaatctaattatactttcctacttattcttttttttttttttttttgagacggagtctccctcagtcgcccaggctggagtgcagtggcatgatctcagttcactgcaagctctgcctcctagctctgcctcctgggttcatgccattctcctgtctcagcctcgcgagtagctgggactacaggcgcctgccaccgtgcccggctaatttttttttttgtatttttggtagagacagggtttcaccgtgttagccaggatggtctcgatctcctgacctcataatccgcccgtctcggcctcccaaagtgctgggattacaggcatgagccaccgcccccagcctatttattcttaaatgtacaataaattattgttgactccagtcaccctgctgtgctaccaaatacggatcttcttcattctatctaactgtatttctgtacctgttaaccatctctcctccacctcaccccccaaacccactacccttctcagcctctggtaaccatccttctactctctatctctatgagttcaattgtattaatttttagctccccggccgggcacggtggctcacgcctgtaatcccagcacttcaggaggctgaggcaggtggatcacgaggtcaggagtttgagaccagcctggccaacatggtggaaccccatctctactaaaaacacaaaaattagctgggcgtggtggtgggcgcttgtagtcccagctacttgggaggctgaggcaggagaatcgcttgaaactgggaggcagaggttgcagtgagccaagattgcgccactgcactccagtctgggtgacagagtaagattccatcccgaaaaaaaaaaagtttagctcccacaaataagtgagaacacgtgaagtttctctttctgtgcctcgcttgtttcacttaacataatgacctccagttccatccacgttgttgctttgttataaatgacaggatcttggtcaggcgcagtggctcatgcctgtaatcccagcactttgggaggctgaggtggactgatcatgaggtcaagagatcgagaccatcctggctaacacagtgaaaccccgtctctactaaaaatacaagaaattagccgggcgtggtggtgggcacccatttccgccccttctcgggacgctgatgcacgacatattacccatccccggaagactaatcctcccccactctatattgtacctcttcctttctcctccacgcgattccccgagtaacccgtcttccctccctcctcggattacgctcacctttccgcttcaatcacgttgctccgtccccttccccattcgtaccactcctcactttcgtcttcctacccccactatcccttttcgtcctctctattccttacttactcctcccccttctcttcatacttcattccctccgctcttcccactcgcgctcccactttcacctagttgccctcacctacgttgccatctcgccccttcttcagctctcggcctctcacccatctgtcctctctcttacctctctcctcatctcgctcagacatctctctagactatccctcactttaccttctcagtcgtcttcttcctatccttcgttctccatgatcttcacgtcgccatctcttttcgcccctttcatatgtctctcttcatgttctcactatcattctcatgatcactatcgttctcactacttatcactcccctctttcttcatcaattcctctccgtcattctcgtctctctcttacaaccgccttccttgtgctatctaactcaaccatgcctctcctactctctctctatcgcccctccatcgcttatgcatcctcttctattgcacacccgcccctccatcgcttatgcatcctcttctattgcacaccgcccctccatcgcttatgcatcctcttctattgcacatcctcttctattgcac

SEQ ID NO: 12 - DNA, 21 bp, Artificial Sequence
  Primer
ctgagcggaattcgtgagacc

SEQ ID NO: 13 - DNA, 23 bp, Artificial Sequence
  Primer
ttggtctcacgtattccgctcga

SEQ ID NO: 14 - DNA, 20 bp, Artificial Sequence
  Primer
ctcgagaattctggatcctc

SEQ ID NO: 15 - DNA, 22 bp, Artificial Sequence
  Primer
ttgaggatccagaattctcgag

SEQ ID NO: 16 - DNA, 21 bp, Artificial Sequence
  Primer
tgtatgcgaattcgctgcgcg

SEQ ID NO: 17 - DNA, 23 bp, Artificial Sequence
  Primer
ttcgcgcagcgaattcgcataca

SEQ ID NO: 18 - DNA, 21 bp, Artificial Sequence
  Primer
gtccactgaattctcagtgag

SEQ ID NO: 19 - DNA, 23 bp, Artificial Sequence
  Primer
ttgtcactgagaattcagtggac

SEQ ID NO: 20 - DNA, 21 bp, Artificial Sequence
  Primer
gaatccgaattcctggtcagc

SEQ ID NO: 21 - DNA, 23 bp, Artificial Sequence
  Primer
ttgctgaccaggaattcggattc

SEQ ID NO: 22 - DNA, 33 bp, Artificial Sequence
  Primer
cuacuacuacuactgagcggaattcgtgagacc

SEQ ID NO: 23 - DNA, 32 bp, Artificial Sequence
  Primer
cuacuacuacuactcgagaattctggatcctc

SEQ ID NO: 24 - DNA, 33 bp, Artificial Sequence
  Primer
cuacuacuacuatgtatgcgaattcgctgcgcg

SEQ ID NO: 25 - DNA, 33 bp, Artificial Sequence
  Primer
cuacuacuacuagtccactgaattctcagtgag

SEQ ID NO: 26 - DNA, 33 bp, Artificial Sequence
  Primer
cuacuacuacuagaatccgaattcctggtcagc

SEQ ID NO: 27 - DNA, 45 bp, Artificial Sequence
  Primer
aactggaagaattcgcggccgcaggaatttttttttttttttttt

SEQ ID NO: 28 - DNA, 13 bp, Artificial Sequence
  Primer
aattcggcacgag

SEQ ID NO: 29 - DNA, 9 bp, Artificial Sequence
  Primer
ctcgtgccg

SEQ ID NO: 30 - DNA, 14 bp, Artificial Sequence
  Primer
gtacgacggccagt

SEQ ID NO: 31 - DNA, 16 bp, Artificial Sequence
  Primer
aacagctatgaccatg

SEQ ID NO: 32 - DNA, 18 bp, Artificial Sequence
  Primer
ccaagttctgagaagtcc

SEQ ID NO: 33 - DNA, 20 bp, Artificial Sequence
  Primer
aatacctgaaaccatacctg

SEQ ID NO: 34 - DNA, 57 bp, Artificial Sequence
  Primer
agctgctcgtagctgtctctccctggatcacgggtacatgtactggacagactgggt

SEQ ID NO: 35 - DNA, 56 bp, Artificial Sequence
  Primer
tgagacgcccggattgagcgggcagggatagcttattccctgtgccgcattacggc

SEQ ID NO: 36 - DNA, 27 bp, Artificial Sequence
  Primer
agctgctcgtagctgtctctccctgga

SEQ ID NO: 37 - DNA, 27 bp, Artificial Sequence
  Primer
gccgtaatgcggcacagggaataagct

SEQ ID NO: 38 - DNA, 20 bp, Artificial Sequence
  Primer
gagaggctatatccctgggc

SEQ ID NO: 39 - DNA, 20 bp, Artificial Sequence
  Primer
acagcacgtgtttaaagggg

SEQ ID NO: 40 - DNA, 163 bp, Homo sapiens
actaaagcgccgccgccgcgccatggagcccgagtgagctcggcgcgggcccgtccggccgccggacaacatggaggcagctccgcccgggccgccgtggccgctgctgctgctgctgctgctgctgctggcgctgtgcggctgcccggcccccgccgcggcc

SEQ ID NO: 41 - DNA, 419 bp, Homo sapiens
gccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctg

SEQ ID NO: 42 - DNA, 221 bp, Homo sapiens
ccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccac

SEQ ID NO: 43 - DNA, 221 bp, Homo sapiens
tccctgactgcaggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctatactcacccatggacatccaggtgctgagccaggagcggcagcctttttgtgagtgccgg

SEQ ID NO: 44 - DNA, 156 bp, Homo sapiens
tttctcagtccacactcgctgtgaggaggacaatggcggctggtcccacctgtgcctgctgtccccaagcgagcctttttacacatgcgcctgccccacgggtgtgcagatgcaggacaacggcaggacgtgtaaggcaggtgaggcggtgggacg

SEQ ID NO: 45 - DNA, 416 bp, Homo sapiens
ctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggc

SEQ ID NO: 46 - DNA, 198 bp, Homo sapiens
ttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtgg

SEQ ID NO: 47 - DNA, 244 bp, Homo sapiens
ccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtc

SEQ ID NO: 48 - DNA, 313 bp, Homo sapiens
gttcgcttccaggaaccaacccgtgtgcggacaggaacggggggtgcagccacctgtgcttctgcacaccccacgcaacccggtgtggctgccccatcggcctggagctgctgagtgacatgaagacctgcatcgtgcctgaggcctttttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggc

SEQ ID NO: 49 - DNA, 255 bp, Homo sapiens
cctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtc

SEQ ID NO: 50 - DNA, 210 bp, Homo sapiens
gtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggct

SEQ ID NO: 51 - DNA, 352 bp, Homo sapiens
gtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggt

SEQ ID NO: 52 - DNA, 225 bp, Homo sapiens
gcctcctctacgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgg

SEQ ID NO: 53 - DNA, 235 bp, Homo sapiens
ctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaac

SEQ ID NO: 54 - DNA, 218 bp, Homo sapiens
ccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccgg

SEQ ID NO: 55 - DNA, 234 bp, Homo sapiens
ggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggc

SEQ ID NO: 56 - DNA, 157 bp, Homo sapiens
ttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgc

SEQ ID NO: 57 - DNA, 272 bp, Homo sapiens
gttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacggtgaggccctcc

SEQ ID NO: 58 - DNA, 134 bp, Homo sapiens
tctccttgcagccatctgcctgcccaaccagttccggtgtgcgagcggccagtgtgtcctcatcaaacagcagtgcgactccttccccgactgtatcgacggctccgacgagctcatgtgtggtgagccagctt

SEQ ID NO: 59 - DNA, 274 bp, Homo sapiens
gtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaa

SEQ ID NO: 60 - DNA, 164 bp, Homo sapiens
cttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggg

SEQ ID NO: 61 - DNA, 130 bp, Homo sapiens
ttggctctcctcagatcctgaacccgccgccctccccggccacggacccctccctgtacaacatggacatgttctactcttcaaacattccggccactgcgagaccgtacaggtaggacatcccctgcag

SEQ ID NO: 62 - DNA, 496 bp, Homo sapiens
tcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 63 - DNA, 3081 bp, Homo sapiens
cccgccagcccagcccagcccaaccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccttgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgcccacagatgtgaaatgaatgtaatctaatagaagcctaatcagcccaccatgttctccactgaaaaatcctctttctttggggtttttctttctttcttttttgattttgcactggacggtgacgtcagcctgtacaggctcccaggggtggcgtcaaatgctattgaaattgcgctgaatcgtatgctttttccttttgataaataaacaatgtaaaaatgtttcaaaaacctaataaaataaataaatacg

SEQ ID NO: 64 - DNA, 1324 bp, Homo sapiens
  misc_feature (1)...(1324): n = A,T,C or G
ggccgcccggcgcccccagcagnccgagccggggcgcacagncggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaatctcccatagtatttatggtggcgccggcggggccccagcccagcttgcaggccacctctagctttcttcctaccccattccggcttccctcctcctcccctgcagcctggttaggtggatacctgccctgacatgtgaggcaagctaaggcctggagggtcagatgggagaccaggtcccaagggagcaagacctgcgaagcgcagcagccccggcccttcccccgttttgaacatgtgtaaccgacagtctgccctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtact

SEQ ID NO: 65 - DNA, 2377 bp, Homo sapiens
ggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttaaaaaaaaaaaaaaaaaaa

SEQ ID NO: 66 - DNA, 1295 bp, Homo sapiens
gggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggcccgagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttg

SEQ ID NO: 67 - DNA, 3411 bp, Homo sapiens
gggcccggggtcccgccaccaccgcgcgcgggacagattgattcactttggagctgtaagtactgatgtattagggtgcagcgctcattgttcattgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggacgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgcgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgcttgtgttggacatgggcttgtgccgggctccgggatgcacacgaggagaaccctgagagcatcctggacgagcacgtacagcgtgtgctgaggacaactggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgttgcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagaccyttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccaagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctagggccagcaggggctgcccgagtctgtttttcatgcgatgacacttgtacaattatcttttcaaaggtacttggataataatgaaataaaactgtttttgaacctgaataaaaaaaaaaaaaaaaaaaaaaaaaa

SEQ ID NO: 68 - DNA, 3140 bp, Homo sapiens
ggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaataccgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtacccttaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataataaaaaaaaaaaaaaaaaa

SEQ ID NO: 69 - DNA, 3513 bp, Homo sapiens
ccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcctagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 70 - DNA, 3597 bp, Homo sapiens
catgccagttacttcctcaggaaaatattttcttgccttcttctttcagtatggttttaaatttgggaacagtggataacccaagtgtcccacaggccaaggtatattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtgttgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagtcccagccagctcttcaaggccttcaaggggtctttccatgactgagtcacctccaggagctcacctgacccccagagaagacctaccccaggcagctccgtgccctggcttctccccatgccccaaatcccccccagccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttttatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttatcttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttttactacaaatttttgctcccccataaaattatttttttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccaacaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccgaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacgaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaactggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttaaacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctatgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataagaaaaaaaaaaaaaaaaaaaa

SEQ ID NO: 71 - DNA, 855 bp, Homo sapiens
cgctcaattatctactcgagtctagactcgaggcggccgcccattgtgcactaaagcaggggatagcaacggcgtccctcctccccgctcagctgcagcccgcagtcctcacagtggtaacatgccacgtggtagtctctgtccatggacaccacacggatggttgtctcgcagccctgtgcagggaggataggacgggcacaggaggcgcattttggtgcaaaaaccgtgtgatagtctcgcacgcagtagatgttgttctccacgtccacggtgaagggaaccccgtccaggcactcattgcacacggagcaccggaagcagcctgggtggtaggacttgcccagggcctgcaggatcatttccatgatgagatgtccacacacgctgcatttgtcggccgtctgctggaacccggagtacaggaagtcctcctggcagtacactttctcacccacgttgtagaacgccttcccacggagtcgtctcccacacgagtcgcaggtgaagcagtcagtgtgataaagactccccattgcctggcacgcctgctgggctccgtagatgccaagcccacacttgatgcaaatgccgaagtagtcccgcgccgtgcgcgcctcgagcgcccgctccagctcccgggtgagcgcctccagccgccgctcggccgcgcttgggccgccctcccggccagggggcagcgggagtgcaggcagcgggaagggggccggccccgcaggctccggggagcgagcgggcgcggggcaggcgccgggcgggaggaagtcagcgtaggctttagtgcacaatgggaattcggatccggtcgacactagttctaggatctcttttttt

SEQ ID NO: 72 - DNA, 3791 bp, Homo sapiens
acagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccacctctggaaaaagatcccccgcttgctcctcgctgaccccatcactgtgcaagctggggctgcaggaaggcagcaacaactcgtctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattgtggagtttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgaatcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacattcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatgcgtaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagaatgagaagatcctagaacagatagacaagagtggcgagctcataagccttagagaggaggtgacccaccttacccgctcacttcggcgtgcggagacagagaccaaagtgctccaggaggcctggcaggccagctggactccaactgccagcctatggccaccaattggatccaggagaaagtgtggctctctcaggaggtggacaaactgagagtgatgttcctggagatgaaaaatgagaaggaaaactcctgatcaagttccagagcccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatttgtttcacctctttttacctgcaatacccccttaccccaataccaagaccaactggcatagagccaactgagataaatgctatttaaataaagtgtatttaatgaaaaaaaaaaaaaaaaaaaaa

SEQ ID NO: 73 - DNA, 1683 bp, Homo sapiens
ctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatg

SEQ ID NO: 74 - DNA, 1696 bp, Homo sapiens
cacctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctgtggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 75 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 76 - DNA, 1316 bp, Homo sapiens
tcctaatacgactcactatagggctcgagcggccgcccgggcaggtcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagtcgccccactgagtttgccttctatccgggatatccgggaacctaccacgctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccagaaacctgccaagcccaggctggggccaaggactctgctgagaggcccctagagacaacacccttcccaggccactggctgctggactgttcctcaggagcggcctgggtacccagtatgtgcagggagacggaaccccatgtgacaggcccactccaccagggttcccaaagaacctggcccagtcataatcattcatcctcacagtggcaataatcacgataaccagt

SEQ ID NO: 77 - DNA, 566 bp, Homo sapiens
cccaccaaacccataaagagggtgggtcgacccacgcgtccgcggacgcgtgggaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaa

SEQ ID NO: 78 - DNA, 5067 bp, Homo sapiens
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgggagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccaactggtcagggcagagtgatcgtaactaaaggtcagtggggaatagatccgattcagtgcttttgccttatgcatttcagcatcctggctccccagggtggcaggagctgaggaagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctaacattgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcggtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttct

SEQ ID NO: 79 - DNA, 950 bp, Homo sapiens
tcgaccggatccgaattcccattgtgcactaaagcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgttcccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagctttagtgcacaatgggcggccgcctcgagtctagactcgagtagataattgagcggaatttctt

SEQ ID NO: 80 - DNA, 2346 bp, Homo sapiens
ccgccgtcgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccc

SEQ ID NO: 81 - DNA, 2512 bp, Homo sapiens
caatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataacaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaacatgctggtttctgtagggtatttttaattttgtcagaaattttagattgtgaatattttgtaaaaaacagtaagcaaaattttccagaattcccaaaatgaaccagataccccctagaaaattatactattgagaaatctatggggaggatatgagaaaataaattccttctaaaccacattggaactgacctgaagaagcaaactcggaaaatataataacatccctgaattcaggcattcacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatctgactgctttactttgatgtatcatatttttaaataaaaataaatattcctttagaagatcactctaaaa

SEQ ID NO: 82 - DNA, 2306 bp, Homo sapiens
gggcgggagctgcacgcgccgtggctccggatctcttcgtctttgcagcgtacgcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgacccctacctctaccggcccgttgctgtggctctagacactaaaggacctgagatccgaactgggctcatcaagggcagcggcactgcagagctggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 83 - DNA, 2656 bp, Homo sapiens
gaattcgcggccgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggccccctggtcagcagaggagaggttagatcttgcaggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaagcacgttaaaggcccagagagatcctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgaaaaaaaaaaaaaaaaa

SEQ ID NO: 84 - DNA, 2217 bp, Homo sapiens
gcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 85 - DNA, 8906 bp, Homo sapiens
gaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcacgtgagaacaatctggcaacaccgcaaggtccggctgcatcagaggctgcagctgtgtgttttccagcaggaagttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaaatatcagctccttttaaaagagctgctgacgtgctgtgaggaaggaaagggagagattaaagatggcctggaggtgatgctcagcgtgccgaagcgagccaatgacgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcatcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgccaaggacggaggtcgcattgctgtatcacagtattttttacggatttctg

SEQ ID NO: 86 - DNA, 1204 bp, Homo sapiens
tcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaacaacaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaa

SEQ ID NO: 87 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 88 - protein, 197 aa, Homo sapiens
MMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 89 - protein, 739 aa, Homo sapiens
GDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 90 - protein, 431 aa, Homo sapiens
GPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGARVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHG

SEQ ID NO: 91 - protein, 900 aa, Homo sapiens
GPGSRHHRARDRLIHFGAVSTDVLGCSAHCSLTQSPKMNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESAQVNGRVPLPHIPRTYRVPKEVRVEPQKFAEELIHRLEAVQRTREAEEKLEERLKRVRMEEEGEDGDPSSGPPGPCHKLPPAPAWHHFPPRLCWTWACAGLRDAHEENPESILDEHVQRVLRTTGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 92 - protein, 591 aa, Homo sapiens
MVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 93 - protein, 914 aa, Homo sapiens
VYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFLEEAALEAEAELGGQPSLTAEDSEISSQCPSASGSSGSDSSCVSGQALGRGLEDLPCV

SEQ ID NO: 94 - protein, 277 aa, Homo sapiens [sequence omitted]

SEQ ID NO: 95 - protein, 1120 aa, Homo sapiens
MWRVKKLSLSLSPSPQTGKPSMRTPLRELTLQPGALTTSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVIVEFLSRQLRDWKSQLAVPHPETQDSSTQTDTSHSGITNKLQHLKESHEMGQALQQARNVMQSWVLISKELISLLHLSLLHLEEDKTTVNQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENIRLATDLRAQLQILANMDSQLKELQSQHTHCAQDLAMKDELLCQLTQSNEEQAAQCVKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQNEKILEQIDKSGELISLREEVTHLTRSLRRAETETKVLQEAWQASWTPTASLWPPIGSRRKCGSLRRWTN

SEQ ID NO: 96 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 97 - protein, 462 aa, Homo sapiens [sequence omitted]

SEQ ID NO: 98 - protein, 2328 aa, Homo sapiens
KSKRQAQQMVQPQSPVAVSQSKPGCYDNGKHYQINQQWERTYLGNVLVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNLNGEPCVLPFTYNGRTFYSCTTEGRQDGHLWCSTTSNYEQDQKYSFCTDHTVLVQTQGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 99 - protein, 188 aa, Homo sapiens
HQTHKEGGSTHASADAWEIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQ

SEQ ID NO: 100 - protein, 284 aa, Homo sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYHAMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 101 - protein, 676 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 102 - protein, 296 aa, Homo sapiens
STGSEFPLCTKASPCSAARAGGRALGWRLQQQRETRGNPGNPGLGVAATMTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCEL

SEQ ID NO: 103 - protein, 500 aa, Homo sapiens
MGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 104 - protein, 387 aa, Homo sapiens
MATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 105 - protein, 531 aa, Homo sapiens [sequence omitted]

SEQ ID NO: 106 - protein, 480 aa, Homo sapiens
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 107 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 108 - protein, 2861 aa, Homo sapiens
MKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRHVRTIWQHRKVRLHQRLQLCVFQQEVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGAAAGVGAAAAAGPPVAAAATVAAPAAAAAPPARAGAGPPGSPSLSDTTPPCWSPLQPRARQRQTRCQSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 109 - protein, 271 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 110 - protein, 233 aa, Homo sapiens
NSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 111 - protein, 212 aa, Homo sapiens
NSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSC

SEQ ID NO: 112 - protein, 149 aa, Homo sapiens
NSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTK

SEQ ID NO: 113 - protein, 170 aa, Homo sapiens
CASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 114 - protein, 128 aa, Homo sapiens
VSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 115 - protein, 84 aa, Homo sapiens
GQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 116 - protein, 149 aa, Homo sapiens
CASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSC

SEQ ID NO: 117 - protein, 107 aa, Homo sapiens
VSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSC

SEQ ID NO: 118 - protein, 15 aa, Homo sapiens
GNKYQTIDNYQPYPC

SEQ ID NO: 119 - protein, 22 aa, Homo sapiens
LDGYSRRTTLSSKMYHTKGQEG

SEQ ID NO: 120 - protein, 21 aa, Homo sapiens
RIQKDHHQASNSSRLHTCQRH

SEQ ID NO: 121 - protein, 15 aa, Homo sapiens
RGEIEETITESFGND

SEQ ID NO: 122 - protein, 19 aa, Homo sapiens
EIFQRCYCGEGLSCRIQKD

SEQ ID NO: 123 - protein, 13 aa, Artificial Sequence
  LRP5/HBM amino acid sequence
MYWTDWVETPRIE

SEQ ID NO: 124 - protein, 13 aa, Artificial Sequence
  LRP5/HBM amino acid sequence
MYWTDWGETPRIE

SEQ ID NO: 125 - protein, 13 aa, Artificial Sequence
  LRP5/HBM amino acid sequence
KRTGGKRKEILSA

SEQ ID NO: 126 - protein, 17 aa, Artificial Sequence
  LRP5/HBM amino acid sequence
ERVEKTTGDKRTRIQGR

SEQ ID NO: 127 - protein, 16 aa, Artificial Sequence
  LRP5/HBM amino acid sequence
KQQCDSFPDCIDGSDE

SEQ ID NO: 128 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 129 - DNA, 39 bp, Artificial Sequence
  complementary synthetic oligonucleotide
tggtcagcggcctggaggatgtggccgcagtggacttcc

SEQ ID NO: 130 - DNA, 39 bp, Artificial Sequence
  complementary synthetic oligonucleotide
ggaagtccactgcggccacatcctccaggccgctgacca

SEQ ID NO: 131 - DNA, 40 bp, Artificial Sequence
  complementary synthetic oligonucleotide
aagctgtactggacggactcagtgaccaaccgcatcgagg

SEQ ID NO: 132 - DNA, 40 bp, Artificial Sequence
  complementary synthetic oligonucleotide
cctcgatgcggttggtcactgagtccgtccagtacagctt

SEQ ID NO: 133 - DNA, 41 bp, Artificial Sequence
  complementary synthetic oligonucleotide
atgtactggacagactggaaggagacgccccggattgagcg

SEQ ID NO: 134 - DNA, 41 bp, Artificial Sequence
  complementary synthetic oligonucleotide
cgctcaatccggggcgtctccttccagtctgtccagtacat

SEQ ID NO: 135 - DNA, 41 bp, Artificial Sequence
  complementary synthetic oligonucleotide
atgtactggacagactggtttgagacgccccggattgagcg

SEQ ID NO: 136 - DNA, 41 bp, Artificial Sequence
  complementary synthetic oligonucleotide
cgctcaatccggggcgtctcaaaccagtctgtccagtacat

SEQ ID NO: 137 - DNA, 41 bp, Artificial Sequence
  complementary synthetic oligonucleotide
atgtactggacagactggattgagacgccccggattgagcg

SEQ ID NO: 138 - DNA, 41 bp, Artificial Sequence
  complementary synthetic oligonucleotide
cgctcaatccggggcgtctcaatccagtctgtccagtacat

SEQ ID NO: 139 - DNA, 41 bp, Artificial Sequence
  complementary synthetic oligonucleotide
atgtactggacagactggcaggagacgccccggattgagcg

SEQ ID NO: 140 - DNA, 41 bp, Artificial Sequence
  complementary synthetic oligonucleotide
cgctcaatccggggcgtctcctgccagtctgtccagtacat

SEQ ID NO: 141 - DNA, 42 bp, Artificial Sequence
  complementary synthetic oligonucleotide
cggacatttactggcccaatgtactgaccatcgacctggagg

SEQ ID NO: 142 - DNA, 42 bp, Artificial Sequence
  complementary synthetic oligonucleotide
cctccaggtcgatggtcagtacattgggccagtaaatgtccg

SEQ ID NO: 143 - DNA, 40 bp, Artificial Sequence
  complementary synthetic oligonucleotide
agctctactgggctgacgtcaagctcagcttcatccaccg

SEQ ID NO: 144 - DNA, 40 bp, Artificial Sequence
  complementary synthetic oligonucleotide
cggtggatgaagctgagcttgacgtcagcccagtagagct

SEQ ID NO: 145 - DNA, 41 bp, Artificial Sequence
  complementary synthetic oligonucleotide
gagtgccctctactcacccgtggacatccaggtgctgagcc

SEQ ID NO: 146 - DNA, 41 bp, Artificial Sequence
  complementary synthetic oligonucleotide
ggctcagcacctggatgtccacgggtgagtagagggcactc

SEQ ID NO: 147 - DNA, 45 bp, Artificial Sequence
  complementary synthetic oligonucleotide
catgtactggacagactgggtagagaaccctaaaatcgagtgtgc

SEQ ID NO: 148 - DNA, 45 bp, Artificial Sequence
  complementary synthetic oligonucleotide
gcacactcgattttagggttctctacccagtctgtccagtacatg

SEQ ID NO: 149 - DNA, 42 bp, Artificial Sequence
  complementary synthetic oligonucleotide
catctactggaccgagtgggtcggcaagccgaggatcgtgcg

SEQ ID NO: 150 - DNA, 42 bp, Artificial Sequence
  complementary synthetic oligonucleotide
cgcacgatcctcggcttgccgacccactcggtccagtagatg

SEQ ID NO: 151 - DNA, 42 bp, Artificial Sequence
  complementary synthetic oligonucleotide
gtacttcaccaacatggtggaccgggcagccaagatcgaacg

SEQ ID NO: 152 - DNA, 42 bp, Artificial Sequence
  complementary synthetic oligonucleotide
cgttcgatcttggctgcccggtccaccatgttggtgaagtac

SEQ ID NO: 153 - DNA, 42 bp, Artificial Sequence
  complementary synthetic oligonucleotide
gtactggacagactgggtagaagtgccaaagatagaacgtgc

SEQ ID NO: 154 - DNA, 42 bp, Artificial Sequence
  complementary synthetic oligonucleotide
gcacgttctatctttggcacttctacccagtctgtccagtac

SEQ ID NO: 155 - DNA, 31 bp, Artificial Sequence
  primer
ttttttgtcgaccaattccaacgctatcaag

SEQ ID NO: 156 - DNA, 31 bp, Artificial Sequence
  primer
ttttttgtcgacctgcgctagtcccacccgc

SEQ ID NO: 157 - DNA, 32 bp, Artificial Sequence
  primer
ttttttgtcgaccgtgtcttctgatcaaaatc

SEQ ID NO: 158 - DNA, 33 bp, Artificial Sequence
  primer
ttttttgtcgaccggacaagaaggttctgtttg

SEQ ID NO: 159 - DNA, 37 bp, Artificial Sequence
  primer
ttttttgcggccgcttatttggtgtgatacatttttg

SEQ ID NO: 160 - DNA, 35 bp, Artificial Sequence
  primer
ttttttgcggccgcttagcaagacagaccttctcc

SEQ ID NO: 161 - DNA, 35 bp, Artificial Sequence
  primer
ttttttgcggccgcttagtgtctctgacaagtgtg

SEQ ID NO: 162 - DNA, 34 bp, Artificial Sequence
  primer
cagtgaattcaccatgcaaaacaccactttgttc

SEQ ID NO: 163 - DNA, 32 bp, Artificial Sequence
  primer
cagttgcggccgctcatctccggtggcctctg

SEQ ID NO: 164 - DNA, 39 bp, Homo sapiens
  primer
caatagtcgacgaattcaccatggctctgggcgcagcgg

SEQ ID NO: 165 - DNA, 42 bp, Homo sapiens
  primer
gtattgcggccgctctagattagtgtctctgacaagtgtgaa

SEQ ID NO: 166 - DNA, 32 bp, Homo sapiens
  primer
ctaacggatccaccatggccgcgttgatgcgg

SEQ ID NO: 167 - DNA, 33 bp, Homo sapiens
  primer
gattcgaattctcaaattttctgacacacatgg

SEQ ID NO: 168 - DNA, 690 bp, Homo sapiens
aattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaa

SEQ ID NO: 169 - DNA, 1226 bp, Homo sapiens
ctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtggtggacctgcgcctgcgctgcgacggcgaggcagactgtcaggaccgctcagacgaggcggactgtgacgccatctgcctgcccaaccagttccggtgtgcgagcggccagtgtgtcctcatcaaacagccagtgcgactccttccccgactgtatcgacggctccgacgagctcatgtgtgaaatcaccaagccgccc

SEQ ID NO: 170 - DNA, 934 bp, Homo sapiens
agggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgcctccgccgcccagttcccctgcgcgcggggtcagtgtgtggacctgcgcctgcgctgcgacggcgaggcagactgtcaggaccgctcagacgaggcggactgtgacgccatctggcctgcccaaccagttccggtgtgcgagcggccagtgtgtcctcatcaaacagcagtgcgactccttccccgactgtatcgacggctccgacgagctcatgtgtgaaatcaccaagccgccctaagcggccgc

SEQ ID NO: 171 - protein, 16 aa, Homo sapiens
SVGCLLCAGLGVWSLS

SEQ ID NO: 172 - protein, 19 aa, Homo sapiens
WCCCGLFRGVCVWSCGADD

SEQ ID NO: 173 - protein, 16 aa, Homo sapiens
GWRRCDWCGCVSWCWV

SEQ ID NO: 174 - protein, 32 aa, Homo sapiens
MPGSVSHCWGGICEALSCCAVDVCLRCGGWFR

SEQ ID NO: 175 - protein, 16 aa, Homo sapiens
SCCAVDVCLRCGGWFR

SEQ ID NO: 176 - protein, 16 aa, Homo sapiens
SVLGTCCCCGGWILCE

SEQ ID NO: 177 - protein, 16 aa, Homo sapiens
VLSVCEVCGGVFVRRC

SEQ ID NO: 178 - protein, 15 aa, Homo sapiens
GMWYWSGRDCALCWL

SEQ ID NO: 179 - protein, 16 aa, Homo sapiens
CTAVMWGVGSVAYLGE

SEQ ID NO: 180 - protein, 13 aa, Homo sapiens
VVCWWCGCRGWWR

SEQ ID NO: 181 - protein, 16 aa, Homo sapiens
CVCASFCCCVCGLRLL

SEQ ID NO: 182 - protein, 16 aa, Homo sapiens
TYEVCEECGGRVRMWV

SEQ ID NO: 183 - protein, 16 aa, Homo sapiens
VVVCASCGQVWHGSGA

SEQ ID NO: 184 - protein, 16 aa, Homo sapiens
CCRCCHCWDCEWHMCV

SEQ ID NO: 185 - protein, 16 aa, Homo sapiens
FCASCCWCGCDCFGWV

SEQ ID NO: 186 - protein, 16 aa, Homo sapiens
CDYCWSCGVWCPSSWL

SEQ ID NO: 187 - protein, 16 aa, Homo sapiens
VYLCVWCGAARFGCYG

SEQ ID NO: 188 - protein, 16 aa, Homo sapiens
FCVCGCCWCWCAACWC

SEQ ID NO: 189 - protein, 16 aa, Homo sapiens
VVLCSRCGRLWRWSCG

SEQ ID NO: 190 - protein, 16 aa, Homo sapiens
EVRQVTCIRCRRGFLL

SEQ ID NO: 191 - protein, 15 aa, Homo sapiens
GGGGMWEAWSCYACG

SEQ ID NO: 192 - protein, 16 aa, Homo sapiens
GWRWCGRCGALWWRRV

SEQ ID NO: 193 - DNA, 485 bp, Homo sapiens
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccgtggttctgtgttcgcgttgtgggcgtttgtggcggtggtcgtgtgggactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 194 - DNA, 485 bp, Homo sapiens
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccgggtggcggtggtgtggtcggtgtggggctttgtggtggcggcgtgttactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 195 - DNA, 485 bp, Homo sapiens
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccgaggtgcggcaggttacgtgtattaggtgtcgtcggggttttctgttgactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 196 - DNA, 485 bp, Homo sapiens
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccggtggtggggggatgatttgggaggcttggagttgttatgcgtgtgggactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 197 - DNA, 485 bp, Homo sapiens
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccttgtggattgggccgggtgatcagggtctgtttcggcgttttgtttttactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 198 - DNA, 476 bp, Homo sapiens
aagcttgccaccatggagacagacacactcctgctatgggtactgctgctctgggttccaggttccactggtgacggatccgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaagcggccgc

SEQ ID NO: 199 - DNA, 539 bp, Homo sapiens
aagcttgccaccatggagacagacacactcctgctatgggtactgctgctctgggttccaggttccactggtgacggatcctgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgctaagcggccgc

SEQ ID NO: 200 - DNA, 416 bp, Homo sapiens
aagcttgccaccatgggcgataaaattattcacctgactgacgacagttttgacacggatgtactcaaagcggacggggcgatcctcgtcgatttctgggcagagtggtgcggtccgaattcctatgcgtggttgttttcttgtagtaggtgtaggtggtggttgccttggactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 201 - DNA, 416 bp, Homo sapiens
aagcttgccaccatgggcgataaaattattcacctgactgacgacagttttgacacggatgtactcaaacgccacggggcgatcctcgtcgatttctgggcagagtggtgcggtccgaattccatttgtgaggttgtgaggttgtggagtcggtatccttggtcttgggtgactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 202 - DNA, 422 bp, Homo sapiens
aagcttgccaccatgggcgataaaattattcacctgactgacgacagttttgacacggatgtactcaaagcggacggggcgatcctcgtcgatttctgggcagagtggtgcggtccgaattccggttgtactagtgcggtgtgtggtgcttgggctgaggcgggtaggttttattgtactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 203 - DNA, 416 bp, Homo sapiens
aagcttgccaccatgggcgataaaattattcacctgactgacgacagttttgacacggatgtactcaaagcggacggggcgatcctcgtcgatttctgggcagagtggtgcggtccgaattccttgtggattgggccgggtgatcagggtctgtttcggcgttttgtttttactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 204 - protein, 154 aa, Homo sapiens
METDTLLLWVLLLWVPGSTGDGSMSDKIIHLTDDSFDTDVLKADGAILVDFWAEWCGPNSVVLCSRCGRLWRWSCGTSGPCKMIAPILDEIADEYQGKLTVAKLNIDQNPGTAPKYGIRGIPTLLLFKNGEVAATKVGALSKGQLKEFLDANLA

SEQ ID NO: 205 - protein, 154 aa, Homo sapiens
METDTLLLWVLLLWVPGSTGDGSMSDKIIHLTDDSFDTDVLKADGAILVDFWAEWCGPNSGWRWCGRCGALWWRRVTSGPCKMIAPILDEIADEYQGKLTVAKLNIDQNPGTAPKYGIRGIPTLLLFKNGEVAATKVGALSKGQLKEFLDANLA

SEQ ID NO: 206 - protein, 154 aa, Homo sapiens
METDTLLLWVLLLWVPGSTGDGSMSDKIIHLTDDSFDTDVLKADGAILVDFWAEWCGPNSEVRQVTCIRCRRGFLLTSGPCKMIAPILDEIADEYQGKLTVAKLNIDQNPGTAPKYGIRGIPTLLLFKNGEVAATKVGALSKGQLKEFLDANLA

SEQ ID NO: 207 - protein, 154 aa, Homo sapiens
METDTLLLWVLLLWVPGSTGDGSMSDKIIHLTDDSFDTDVLKADGAILVDFWAEWCGPNSGGGGMIWEAWSCYACGTSGPCKMIAPILDEIADEYQGKLTVAKLNIDQNPGTAPKYGIRGIPTLLLFKNGEVAATKVGALSKGQLKEFLDANLA

SEQ ID NO: 208 - protein, 154 aa, Homo sapiens
METDTLLLWVLLLWVPGSTGDGSMSDKIIHLTDDSFDTDVLKADGAILVDFWAEWCGPNSLWIGPGDQGLFRRFVFTSGPCKMIAPILDEIADEYQGKLTVAKLNIDQNPGTAPKYGIRGIPTLLLFKNGEVAATKVGALSKGQLKEFLDANLA

SEQ ID NO: 209 - protein, 151 aa, Homo sapiens
METDTLLLWVLLLWVPGSTGDGSVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 210 - protein, 172 aa, Homo sapiens
METDTLLLWVLLLWVPGSTGDGSCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSC

SEQ ID NO: 211 - protein, 131 aa, Homo sapiens
MGDKIIHLTDDSFDTDVLKADGAILVDFWAEWCGPNSYAWLFSCSRCRWWLPWTSGPCKMIAPILDEIADEYQGKLTVAKLNIDQNPGTAPKYGIRGIPTLLLFKNGEVAATKVGALSKGQLKEFLDANLA

SEQ ID NO: 212 - protein, 131 aa, Homo sapiens
MGDKIIHLTDDSFDTDVLKRHGAILVDFWAEWCGPNSICEVVRLWSRYPWSWVTSGPCKMIAPILDEIADEYQGKLTVAKLNIDQNPGTAPKYGIRGIPTLLLFKNGEVAATKVGALSKGQLKEFLDANLA

SEQ ID NO: 213 - protein, 133 aa, Homo sapiens
MGDKIIHLTDDSFDTDVLKADGAILVDFWAEWCGPNSGCTSAVCGAWAEAGRFYCTSGPCKMIAPILDEIADEYQGKLTVAKLNIDQNPGTAPKYGIRGIPTLLLFKNGEVAATKVGALSKGQLKEFLDANLA

SEQ ID NO: 214 - protein, 131 aa, Homo sapiens
MGDKIIHLTDDSFDTDVLKADGAILVDFWAEWCGPNSLWIGPGDQGLFRRFVFTSGPCKMIAPILDEIADEYQGKLTVAKLNIDQNPGTAPKYGIRGIPTLLLFKNGEVAATKVGALSKGQLKEFLDANLA

SEQ ID NO: 215 - DNA, 76 bp, Homo sapiens
aagcttgccaccatggagacagacacactcctgctatgggtactgctgctctgggttccaggttccactggtatcc

SEQ ID NO: 216 - protein, 23 aa, Homo sapiens
METDTLLLWVLLLWVPGSTGDGS

We claim:

1. An isolated antibody that binds to a Dkk-1 amino acid sequence selected from the group consisting of:

(a) LDGYSRRTTLSSKMYHTKGQEG; (SEQ ID NO: 119)
(b) RIQKDHHQASNSSRLHTCQRH; (SEQ ID NO: 120) and
(c) RGEIEETITESFGND (SEQ ID NO: 121).

2. The isolated antibody of claim 1, wherein said isolated antibody is polyclonal, monoclonal, chimeric, human, humanized, bispecific, multispecific, primatized, or an antibody fragment.

3. The isolated antibody of claim 2, wherein said antibody fragment is Fab, scFv, Fab', F(ab')$_2$, Fv, F(ab)$_2$, or aggregates thereof.

4. The isolated antibody of claim 1, wherein the isolated antibody has a binding affinity of $10^{-5}$ to $10^{-9}$ M.

5. The isolated antibody of claim 1, wherein said isolated antibody is attached to a solid substrate.

6. The isolated antibody of claim 1, wherein the isolated antibody modulates bone mass when administered to a subject.

7. The isolated antibody of claim 1, wherein the isolated antibody increases bone mass when administered to said subject.

8. A composition comprising the isolated antibody of claim 1 and a pharmaceutically acceptable excipient.

9. The composition of claim 8, wherein said isolated antibody is polyclonal, monoclonal, chimeric, human, humanized, bispecific, multispecifie, primatized, or an antibody fragment.

10. The composition of claim 9, wherein said antibody fragment is Fab, scFv, Fab', F(ab')$_2$, Fv, F(ab)$_2$, or aggregates thereof.

11. The composition of claim 8, wherein the isolated antibody has a binding affinity of $10^{-5}$ to $10^{-9}$ M.

12. The composition of claim 8, wherein said composition modulates bone mass when administered to a subject.

13. The isolated antibody of claim 1, that binds to the Dkk-1 amino acid sequence LDGYSRRTTLSSKMYHTKGQEG (SEQ ID NO: 119).

14. The isolated antibody of claim 1, that binds to the Dkk-1 amino acid sequence RIQKDHHQASNSSRLHTCQRH (SEQ ID NO: 120).

15. The isolated antibody of claim 1, that binds to the DKK-1 amino acid sequence RGEIEETITESFGND (SEQ ID NO: 121).

16. A method of inhibiting Dkk-1 or DKK protein binding to LRP5 in a subject comprising administering the isolated antibody of claim 1 or administering the composition of claim 8 in an amount effective to inhibit Dkk-1 inhibition of LRP5 in said subject.

17. The method of claim 16, wherein said isolated antibody is polyclonal, monoclonal, chimeric, human, humanized, bispecific, multispecific, primatized, or an antibody fragment.

18. The method of claim 17, wherein said antibody fragment is Fab, scFv, Fab', F(ab')$_2$, Fv, F(ab)$_2$, or aggregates thereof.

19. The method of claim 16, wherein the isolated antibody has a binding affinity of $10^{-5}$ to $10^{-9}$ M.

20. The method of claim 16, wherein bone mass is increased in said subject.

21. The method of claim 20, wherein the bone mass increase is determined via one or more of a decrease in fracture rate, an increase in bone strength, an increase in bone mineral density, an increase in trabecular connectivity, an increase in trabecular density, an increase in cortical density, an increase in bone diameter, and an increase in inorganic bone content.

22. The method of claim 20, wherein bone mass increase is determined by X-ray or μCT.

23. The method of claim 16, wherein said subject has a bone development disorder, a bone fracture, age-related bone loss, drug-induced bone disorder, high bone turnover, hyperealcemia, osteogenesis imperfecta, osteomalacia, osteoporosis, and Paget's disease.

24. The method of claim 16, wherein the subject has osteoporosis or post menopausal osteoporosis.

25. The method of claim 16, wherein the isolated antibody modulates the amount of trabecular and/or cortical tissue when administered to said subject.

* * * * *